United States Patent 7,745,391 (HUMAN THROMBOSPONDIN POLYPEPTIDE) - sequence listing, part 158

SEQ ID NO: 410995 - DNA, 588 bp, Homo sapiens
tacaaatagctccctaccattttatcacgtgtagatttgtgtaaccatcactgcagccaagatagagaactatcatcatgatctccctcatgctacctttttgtagccatacctactcccaaccaactctaaccctaggaaccactaatctgttcctcatcgctatattttgtcattatgagaatgttatataaatggaattacataatacacaacctttgagattagcttttttcattcatcacaatgctcttgagagccatccaagttgagagatagatatatatatatatatgatcagtagttaattccttttttattgccaaatagtattccatggtattgatgtgccacgtggtttaactggtattgatgtgccatgtggtttaaccatgtacctattgaaggatattttagttgtttccagtttggtactattacaaataaaactgttgttccttaatttcttaaaaaaaaaaaaaaaaaacacaaacttggcacattgcaagaaaacggacagcaagattaacagtgaactcaatttttatttccaatttcttcaaaattttatacgctaactatgtgtgt

SEQ ID NO: 410996 - DNA, 387 bp, Homo sapiens
acagtagtcatttaaagaggagagagaaagggaggaaaggcagccatcaggtggcgcactgagtccacaccccaaaaggcaaagggctcaccaggaccttaaggacctctgctgctgctgctgctgcttcaggtacctttatcacaacaaatatcctgaccctggggcatagacgggacaatatccatgattccccagtggcataacaaaggggttagtttaaacctgacataggctagagatccttaaaccctatgaaggaactattgccatggaggaggcccctaactctgatgacactgaactgagcctctctggaggaaaaaaaattgtaactgtcccattagagaaagtaccccttttccttgaagtatatccactgaccaa

SEQ ID NO: 410997 - DNA, 853 bp, Homo sapiens
ttctaagccgcccaaagcggggttgcgccggggcctccggggccgaggtgggcctgctcattggaagatcgcatcgcagccatgagcagtaaggatttcttcgcgtgtggacactctggccattgggctcggggatgccctagaggaggagctggagggcgaagaggtggaggccatggcagaggttctcaatgtggttccaccaccctatcttacacctgttactgctgtggtgagtccggtcgtaatgctaagaactgtgtccttctcggaaacatctgctacaactgtgggagaagcggccacatcgccaaagactgtaaggatcctaaacgagagagacgccaacactgttatacctgcggcagactaggacatctggctcgtgactgtgatcgtcagaaagagcagaaatgctactcttgcggcaaacttgggcacattcagaaagactgcgcccaggtcaagtgttaccgatgcggcgagattggccacgtggccatcaattgcagcaaggcgaggccaggtcaactgctaccgctgcggcaaatcccgacatctagccaaggaatgtcccagtgaggttaccacttaaattttcccccccaccccccacccttttgctgattgataattgtattattttctccgaaaacttcactcaccgaaaggtcgatagattgaggctactctcaggcaagtgagctttaattaccatgttaaaggaggaaagagctagaaaaaaaaacctcaaaaaagttaatcattggtagatgccccacaattaacgtgttgcttctcgcccacgggcaaatctagttattaaatagtcattctgagcaccaatcaaaaa

SEQ ID NO: 410998 - DNA, 578 bp, Homo sapiens
ttttcccacttctgctctatttctctccggagcactgttcagcacgtattgaagcattctacatgcttatttttacttatgtgtcttgttctgtcagaatagaagctcatgaaggcagtggtgtctactttgtttcttctgcatccccagtttccgagcatgggcacgaagatgcagcttaataaaggagtgctgatgtgtgagcagatgtatgaactgaaggtgggggcagtgaccactgtggggatgcaagagcaagtgggggagggaggccttactttattgcaaacgagcaagctttctgcaacgcgtcagaaggattagaaaggataagactgcactccgggttttgcagtttctcttttcttttcaattcacgtagaatacaatcactccactaccaaatatttgtcattcatgcatttcctaaactgtaaccacctgcaaggaaaaaaactcaagagcctttgagaaagttgtaatgtcttgcatatcctcatttttatatgttctctatttctgtttagaaggcattgagttactgagtattaaaaataaaagaaactgctgaaaagaaa

SEQ ID NO: 410999 - DNA, 349 bp, Homo sapiens
gtctttccatgttgtccaggctggttgtgaaatcctgggctcaagtgatccacccaccttagtctcccaaagtgctaggattacaggcatgagcctgctcctggccaccctctggtattttccactgttcctggcacatacctcccttagctcttgttacagtcttttgttataatgttggtttaggcctcaggaaacaatctctctggccttctcttgttctttcacctgccccaaggcaggactttaatcttgcccacctttctgattgtgggtcttaagaccctccccagagagggtcctgccctgtgccctatggaaggaagcttccataaaaatttccattaaa

SEQ ID NO: 411000 - DNA, 307 bp, Homo sapiens
atccactattaaaatagttgcataaactctgagttgataagactgaggaaaaccagaaagctggctaggaacagctggacccaaaatggtgttgaatttcagctaggtttcatcttggagaaaatagcgaaaatatcactactactaccatgcagctctgctactaccatacagcagagcagctgatcaaaggcagcaactgcctaactatggacagttcacatgtgaaaaacagaaatccctgtttgtttaattcatgcttactttttctgttatatgaagtaaaaaacattccttactgcaagaa

SEQ ID NO: 411001 - DNA, 300 bp, Homo sapiens
taataaatcctcaagtctagctggtttctaggtttcttttttcctgagccaaatgtatttccttattatttaagatagtctgaatttttgttgctttgttattgttgttctcacttaaacaaaccacctctgatatgttttgttccttctcttgccatgagacacactggctccttttcacattttgctatgattgtaagcttcctgaggctgccaaccagaagctaagcagatgctgttactttgcttgtgaagtctgcagaatgatgagacaaataaacctcttttctttctgaatta

SEQ ID NO: 411002 - DNA, 331 bp, Homo sapiens
cttttctgcaaagttcctaacgtgcctgtaactaccgggatagtattttattttttagagggttggtggcattagtttcgatgtaaggatatcggctggatgtaatgatatctgctagaggggacagttttgaatgtacaattgaagtgtatacggttttttccctcagtcctccctctctccctctcccccagccccccgccaccccgcctctctctctccctctctttctccccctcccctttatatattcatgcatcagagcactcctgcactggaaacagtttgtgctctaccggagattttcatggtaaatttctgaaaacttatt

SEQ ID NO: 411003 - DNA, 222 bp, Homo sapiens
agacaatgacaacaaacatcagcaggctggatcaattgtgtgtggtgcacatgaattttgactgtgacctggcacatgaggtccattgtggaattttccacttgtggcattatgtcggcatttaaaacatttcaaacgttgtagtatttcagatttcagatttttggattagaaatgctcaacctgtattaataactgggtatacaataatctacttagtac

SEQ ID NO: 411004 - DNA, 396 bp, Homo sapiens
gccatcatctacaacctctggttcggctatgacgtgaagcgggccgtggaggagccccggctgcacaaccagcttctgcccaacgtcacgacagtggagagaaacattgaccaggcagtgactgcagccctggagacccggcaccatcacacccagatcgcatccactttcatcgctgtggtgcaagccatcgtccacacggctggtggctgggcagctgcctcggactccaggaaaggcggggagcctgctggctactgagtgctccaggcggacaaggctgacaagcaatctagggacaagatactcactaggaccaggaaggggactctgggggaccggcttcccctgtgagcagcagagcagcacaataaatgaggcactggagaggcggga

SEQ ID NO: 411005 - DNA, 455 bp, Homo sapiens
acaacttaataaactttggctttaatggatgactggatgcagaataaaatacataaaaataaacctcagctgctcagcaacgactgaaaaaccaccaccgggcaatccctccccatggccaccgagcaaagttccaccgcctcccctacgccgaccgccgggctcccggggtcggacagccccgggccacttccgggccttcccggaagtccctgtcacttaacaaccgaagtaacccgcaatgcggaagggcgaggggattgcgagtcaccgagtttcccgcgcggcttgaggtactggggaaccggaatcccccaccggcccaatcatgttgctgctggggtctctccggtgcccagcagtggttgtcagtaagcgggcggcactcccttccgatacgtcttttcttttttcatttttgagacggagtctcgctgtgtcacccaagctggagt

SEQ ID NO: 411006 - DNA, 970 bp, Homo sapiens
acaacttaataaactttggctttaatggatgactggatgcagaataaaatacataaaaataaacctcagctgctcagcaacgactgaaaaaccaccaccgggcaatccctccccatggccaccgagcaaagttccaccgcctcccctacgccgaccgccgggctcccggggtcggacagccccgggccacttccgggccttcccggaagtccctgtcacttaacaaccgaagtaacccgcaatgcggaagggcgaggggattgcgagtcaccgagtttcccgcgcggcttgagtcacggcctagaaagagagatgttggggttcccaggaccaggacagaggtggtagtgaactctcatgggcatccagagaaggtcaggccccttgctgacaggcctatctgtggggctactgctgctcttcagctgggtgacccttgtccagccaacctctctctcagctctggtccaccaccctcacttgtgccagaccacccgggatgtccatggccgtcactaccctggtttcttttgccctcgtctgtctgattctccagaggaagcctactgctgccacctgcaggctgcagggggctcctgctgcacccgggctgaatttgaggccctgtaccaagtcaatctgtccgctcttccgcccccgcccatcctcaggggcccaggcccgctcctagtgctgggcctctacaacctactggttgtgaccctgatgaccgtagacctcgtgcacttctgctgcggtcggggccggagtctgggctggagccaccgcaggcctccctctgggtcctccgccgcgagctccctgcaggtctctgcggggacagcttaggtgcgcccggagcttgcctgcacctgcgatccagagccaagcgccccgcccctgcccgggcgcgctccctccttagccctgcccctctctgaccccacctccgacgcaagagtggggcggg

SEQ ID NO: 411007 - DNA, 389 bp, Homo sapiens
actgataacactttgtaagttgcaattgctggatatcatgtatctatgtgatcaggaccatctgtaatgatgaatggctcatgttcacacagcttcaaatgcctgatttctgaaatgatcaactatttattaggtgtaaggtaagggcaatgatgcatatgatcttctcctgtgcttagagatgttaaaattcacttacggaactacgaacattatgacatgcaataaaacttctaaactatgtagtaacatccaaggcaagattttgtggattatgtgttagtaatgatatttaaagagaatattaacattttgttaagcaaatatattaatatattaattatgtgataattttcattttaaatacaataaattaattttatcgtaag

SEQ ID NO: 411008 - DNA, 386 bp, Homo sapiens
agggccctgcccagcacagcacactggagtggccctgcggcagcatctgggctgctgtacccatggtgcctcccagcccgaggggctcccggcagctctggagactcctgctgtcacgtcacctggcccctcaccatcaccatcctcatctctcttgggaattaagacattgaaggaactgctgctgccagcaagagaggctgttgcaagaaagaaaggctgctgcaagaaacgcaagaaaggctgctgccagcattgcatttctgtcaagaagctgccccgcaaaatttatggatgtatcgctgtatgcacctaatagcaagctctactggatgaatggcttataaagatctcccctgaataaaattgtggtttttaactttaaa

SEQ ID NO: 411009 - DNA, 2564 bp, Homo sapiens
ccaacctgagcaaacacagcagcccgagtgttcccaaggccaaaatgctgagaacgtccactcctaatctgtgtggtggtctgcattgccgggccccctggctctcttctggcattctctgcctctgcctcatattcttgttaggccaggtgggcttgctgcagggacacccccagtgcctggattacgggccccctttccagccccctctgcaccttgagttttgctctgactatgagtccttcggctgctgtgatcagcacaaggaccgccgcatcgctgcccggtactgggacatcatggaatattttgatctgaagagacatgagctgtgtggagattacattaaagacatcctttgccaggagtgctcgccctacgcagcccacctctacgacgccgaaaacacccagacgcctctccggaatctcccgggcctctgctctgattactgctctgccttccattctaactgtcactcagccatttccctgctgaccaatgaccgcggcctccaggagtctcatggaagggacggtacccgcttctgccacctcctggaccttcctgacaaggactattgcttccctaatgtcctgaggaacgactatctcaaccgccacctgggcatggtggcccaagatcctcagggctgcctgcagctctgcctgagcgaggtggccaacgggctgaggaaccccgtctccatggtccatgctggggacggcacccatcgcttctttgttgccgagcaggtaggagtggtgtgggtctacctccctgatgggagtcgcctggagcaacccttcctggacctcaagaacatcgtgttgaccaccccatggatcggggatgagagaggcttcttggggttggcttttcaccccaaattccgccacaatcgcaagttctatatttattattcgtgcctggacaagaagaaggtagaaaagatccgaattagtgagatgaaggtttctcgggctgatcctaacaaagctgacctgaaatcagagagggtcatcttggagattgaagaaccagcctcaaaccataatggcggacaacttctttttggcctggatggctatatgtacatattcactggggacgggggacaggctggagatccctttggcctgtttggaaatgctcagaacaaaagttccctgctgggaaaagttttaaggatcgatgtgaacagggcaggctcacatggcaagcggtaccgagtcccctcggacaatccatttgtttctgagccaggggcccaccccgccatctatgcctatgggatcaggaacatgtggcgttgtgctgtggaccgaggggaccccatcacgcgccagggccgaggccggatattctgtggggacgtgggccagaacaggtttgaagaggttgacctcattttgaaaggtggaaactatggctggagagcaaaggaagggtttgcatgttatgacaaaaaactttgtcacaatgcctctttggatgatgttctgccaatctatgcttatggccatgcagtggggaagtcagtcactggaggttatgtctatcgtggttgtgaatccccaaatctcaatggcctgtatatctttggagacttcatgagtggtcgacttatggctttgcaggaagatagaaaaaacaagaaatggaagaagcaggatctttgcctgggcagcaccacgtcctgtgccttcccagggctgatcagcacccatagcaagttcatcatctcctttgctgaagatgaagcaggggagctgtatttcctggcgacctcttacccaagtgcctatgcaccacgtggatctatttacaagtttgttgacccctcaaggcgagcacccccaggcaagtgcaaatacaagccagtgcccgtgagaaccaagagtaagcggatcccgttcagaccactcgccaagacagtcttggacttgctaaaggaacaatcagagaaagctgctagaaaatcttccagtgcaaccttagcttctggcccagcccagggtttgtctgagaaaggctcctccaagaagctggcttctcctacaagcagcaagaatacattgcgagggcctggtacaaagaagaaagccagagtggggccccacgtccgccagggcaagaggaggaagagcctgaaaagccacagtggcaggatgaggccatcagcagagcagaagcgagctggcagaagtctcccttgacctattggtcaaggtggccgacagggtgacgtgagagaggagagccacctcatcaaatgaaagtcactgctgaataaagaccttagaagtctgggaagccagggtagaggtggggcagggcggttttcctctccctgggaaatcttgctgtctactgaataaataaatgcaccttctctgtatgcagtgcttctgtgggagaccatatcccagattgctggtgcacctgggttatggtaagcactagtccatgagcctgcttggaatcacactggatgtctccgttttgtcttgtaaatgcctacaacctgaggtaataaatcaacatttgctcaaactggcaca

SEQ ID NO: 411010 - DNA, 307 bp, Homo sapiens
gctagtaagtctatgtccctaagattttttacctactgactctgatttctgtcctttaaatatgtaacatgttaaaatgaggagatcggacaagtatcaaataccagtctcctgatcctatgtgatttgaacatgtctcttctctagcaaagccttttaaggatttgaacacagcaatcaagaacctatcttggctgggagcggtggctcacgcctgtaatcccagcaatttttaagacagcccagattgtatttgtttcaagcagcagcagcagacataaaattaaatcaagcctttataaatacg

SEQ ID NO: 411011 - DNA, 497 bp, Homo sapiens
gatatttcaaataatctttcttttgccgtaaattacaagattttccagtttgaccactggcgcttaacctaactacatactgaaggcacttcaagctggtgtgggtggacgttctttcctgttgaaaagagaacaaaaccctcaacaaggagcagctggagacaaacttggagcgaggaaaagcagaaagtgttgcgaagcataatcatttaaatcacagattaagtcaacataatagcagagaaaatgcaggaaattcaaaatgtttgactatagtggcaacctcacagagtcttttctttgggatcaacagagaaaatgagctaaatgaatacaattttatatctcctgacatagaagtaaaggattcatgagcaaatgttttattttatactataatttttaaaatatttcctttaaatacaaagccttaaccaacaaaatgtaaccattagcttcatgaaaaacaataaaaataagagttattaactattacg

SEQ ID NO: 411012 - DNA, 460 bp, Homo sapiens
tgcttccacattttaggtatcggtcatagcaacaaccccacttctcagtagcaactttctctctcagtccgtcttctgtagctgtaacagaatactgcagaccggagcagatagcccagactaccccactgcaggagtctcctgctgaccttgaaagagcaaactgacaatgtagcagggactagcaggtggcttttaagggagtggaagatagcccccggctgacaaccaacaagaaagtatgtctttgtgcctacaactgcatggaactgaattcagtcaacaccctgaacatacttgaaagaggatcccaaactccgcgtgagaaccacaacatggatgacatcttgatttcaactttgcaagaccatgaaagagaacccaggtgctttgtgctcagacttctatcctggagaactgtgatgtaataaatggatgtttttagttgctaagtgtgtaa

SEQ ID NO: 411013 - DNA, 405 bp, Homo sapiens
tgagtatgtgcagatcctaagtcccaaagataactccgcagtcctcatccacagaaacttattggaaaaatgggtctttgcagatgtgattaagttaaggatcttgagatggggagatcatcctggattagctgggtgggccctaaacaccatcaaaagcatccttataagtaagaggcaaagataggctagacacacagagagaagacgacgatatgaaaatggaggcagagatcagagtgatgcagccacagccaaggaatgctggcagataccagaacctggaagagtcaaggaatggcccctcccttagaacctccagaggcattgtggccctgacaacacatgcagttcagacatctggcctccaaaactgggggagaataaattgctgttgtttgaagc

SEQ ID NO: 411014 - DNA, 511 bp, Homo sapiens
ggtattcattgggcgaagcacctcatccagagttaatggcattgccactctgcgaatgagtctcagaaaatgaagaggtagctaaaggaattagcttattaatgtgctatcatcacatctggactggatccagttcttggtgtttgtctggaaaattcactgctgctacagtattgtaatacctggcaattctcatgttaatggaagggttagtagtttgtgttttttaatctacctagtctgtgatgaaactcaaatatttatttgacaataaagtgatgttttttacccaggacaggtgaattcatgaagcaaactatatttgttttccattctgctttcactagcttgtctttaataagttcattgcctcaaagattattaatagcatttggatgatttttccattttgccccagctttaatagctgcctctatgagctcttattatcatttcagagttatttctttaggattctttatagtgaacaagtggtttcaggtaaaaaaaa

SEQ ID NO: 411015 - DNA, 401 bp, Homo sapiens
tggttccactgagaaagtgtgcctatagggaagcagaattacctggagattcatccaagttactgcatttgtcaataattcatttcttgttattgcttggcctctgcaggaatgagcaaagacagccaacctgtgaggctggaagcaagatggagtcagccatgctagacttttctcactgtcatcatctttgcaaaggcagtttcatttctggtagccctgtctttcagctgggtccccaagtgagacacctaagcagagctccacctgctgccttgaagacccacagcctaaagcaaagcttctcctgcggaccctagactcacatctcaaagaaagaagacaaacccagtgtgacccacagcctgggaacttgggagtaaatggctattcttttaagc

SEQ ID NO: 411016 - DNA, 982 bp, Homo sapiens
accacatatgaggaaatcagacatctctaggttgaatcatgcccaaaaggacaatttcttgtcagataagctgctgtgtactaagtctgataactaacaaaattgctatatggtaattttaactggaaattgtccacttttatcctccggttttctctcttattccattggtaaccaccctgggagttctaataccatgtccatgtacaagtgcttaaatcaaccctcaggttgtgacagtcaagctacagtggctgtgaaataatctgcacagcagagtatgctatgtcattggctcaatcagcataatgcagcataatagaatagaagcacacaattatataatgccataatttgatttctctctaatttctggacacatcacaaaataatcaaggcagtgaaatgaagtgtaaagaataatggctgagtttggagtcacatcactgccacttgctagcctgtgtgaccttaaacaaataaaaaactctttcttgacctttagtgtttttctctgtaaaatgggttatcttttctcatttgattatcagataggaatatgtacaacagaggagatgagttgatagtatactttctatgtgccgcctgcaaatgcattatgcacaaattttaattattgccatcatttaaaaaaattcagaagatgttataccttaaaaattagtatttctgcagtctctttaaagtaggatgattgggcaacattagtttcctaatcccacatggcaacaaatgattgtgaagtagccccttcccatttagactgtggtctttgccgggagttcatgtcatttctcatctaacctgatttgcacatgtatgttgaccatctggcccctgtaagcatttgagtttgtcacctctgttgtttataaaagcacttttagatttagctgcaatgtgcttaacaaagtcactcaatttggagcttgaagacgagctttcaaatactggttctcaa

SEQ ID NO: 411017 - DNA, 343 bp, Homo sapiens
ccccatgctctttcattgacggtttggacgctgaggctgtcttgtgcatccaggtggcatttgtcctcttagtacagcttgatgggctttcctttgaggacctcaatgtcacttccttatcacctccaaggctttttctatccagagttcacatgagcacgtactgttaaaaatctactcctcttctttgatggtgcccacatacccaagcagaaggatcatgtatctatcagccaagagggcagaccaccacaagggagttggagagaagaggaaacattcttgaaatgttgcagaaacattatctacaaccaattttttaaaataaacaattgatttcatt

SEQ ID NO: 411018 - DNA, 375 bp, Homo sapiens
aactgaaatggacttaaagaaggcatctgcctgagaccccatttcaatgaaggaagaaaagaaggaagtcatgttttgataaagctatcagaatttaaatatatgtactaggattccatatctgttttggtttaaagaaagaatttttagttggataaatctgacaagatttgaagataaaaacaaaacaaaaatctggatctcgtctttctcttataaagtgcggtttcttcacatcactcaggaatgtttattccaacttaaggcagaacagaaaattgattaatgctgactgctttcctatgactctgtactgtatttacctgaaatataaaccacaatttcaataaatgggtttgtctgataatagcaaaa

SEQ ID NO: 411019 - DNA, 523 bp, Homo sapiens
gtggagagaaagttgcttacttttcctgagcctcaactttctgaaaacatagaaacacaattagatgatgagttatgaggtgaaggaggggatgactcagcagcaatgtgccagctccatagtgacttctccaccaagctggagaaggatttgcagcaatggttccagaaccaactgtgtgtatctacaggatgaagaaactaaggcaacaagcaggatacatccagctgtgctacctgggaggagtcctctcttctataatcaaactcaacagaaacaggcccttgcttctgggacatcaaacatgaagaggctcctgttctgcagaaaataaataaggcgaaatcaaagatttgtagaaattttgattaagacactttctcagtctttccacatagcagacactgaactactgacatgtgctgtagctagaattgagcctgtggacttttatctttgcctttgaattctgttatattgacattaatttggacactcaataaaaaattaacaaaataggaaa

SEQ ID NO: 411020 - DNA, 232 bp, Homo sapiens
ttatatatacattatatgttgtatattatgatacctagactatgtaaagggtgtgtgtgtgagtgtatgactcctacaaagtgagtagttctctggatagtcgaactacagattatttttatgttctctttgattatctgtgtctcctgaagtttctacaatgggcatatactactattttttttcttttttctttttcttttttttttcttttttagagtcagtgtctcac

SEQ ID NO: 411021 - DNA, 359 bp, Homo sapiens
gaaccccagtaatctatcctggacttcaccctaaaagtcaggggtagaaagagccatgccctcttctcttcaaaggaacctttccctgggatcctaaagatcattcctttttgctttatttctctcttgtctgtgtactattttctttggataactccttttcccttctgccattaaacatgctcagacctccttcttataaaaaatgattcttcgtcaataccaaacttttactctaattgaaagttggttagatcaccatgaagaacgttgtataaaaagcttatttaaaaaatcgtaccctttgcacctctgtaattcactttatggaatataccatgaataaataatccacaaaa

SEQ ID NO: 411022 - DNA, 420 bp, Homo sapiens
cctcactgccccgacagcgtccacagcgtcctcaccgtccccacagcgccctcaccgcgtccacagcgtcctcaccgccccgacagctccctcgccgcgtccacagcgtcctcaccgcgtccacagcgtcctcaccgccctgacagctccctcgccgcgtccacagcgtcctcacggccccgacagcgtcctcacggtccccacagcgtcctcaccgtccccacagcgtcctcaccgcgtccacagcgtcctcaccgccccgacagcgtcctcacggtccccacagcgtcctcaccgcccccacagcgtcctcaccgcgtccacagcgccctcaccgcccccacagcgtcctcagtgtccacagcgttctcaccgcccccacagtgtactcattgtccccaatgtcctcattgttacctc

SEQ ID NO: 411023 - DNA, 552 bp, Homo sapiens
gtataattcacagtagtgacagcagcagtgccgaccatccttcccactgagcccttgcacgtgggaagctcttctcggaactctgcatcaattcattaatttcattttcacaagaaatctgtgtagtgcttacatctactctgaatgctcccgatttataaaaaccgagtcacaaagacattaaatttgtccacagccacacagcttgtaagtgcaaagccaggatttaattccagagtttttaggtcaaaaacctatacatcctctccttcctcccatgtcatcgtgtgctgtgcattagattctcacgtgcttggtcacatgccacccagcgtttttattctaagcctttattttaaatttatgccattcttagatgcctacattaaaacacccgggactcagttgttacaaggtctggtttatctgtttcaaatgtactctcctgccttcctctattccctgtaaatgtgaatgtgtgtttatccattaatttagtaaacatctgttgagacccttgcacatgtcagatactgtgaagtacctaataaa

SEQ ID NO: 411024 - DNA, 511 bp, Homo sapiens
ctggcctgtatcattcgaatcctctgctcactttgccttaaaaactggttttggtaggaagaccctgggtaaaggtgggtgctgacttttctagagagggctgaggagacaagcctgaggactcaaacctgccagaggaaaaaggctctaggtattattaacagcagttgtactatgaattacataattgctattcttcgagcctgcagccaagtgccaagattcctcacacgaaccacgtgaagagggcaacaatatccccaccttacagctggaagaaaaaacagctcagaaagtgacctgctttaaaaaaagaaagacggcgatttgctgaaggtcacagagtgcatcctggactaggatgagacgggagaggcactcgcgtaaggggcaaaatctaagaggcgccaaaaaaactcaggaaccaaaaccaatgatattttaatacattttaaaaaccaaaatgtaaaaattcatgatggataaaatatcaacattttaaataacatct

SEQ ID NO: 411025 - DNA, 857 bp, Homo sapiens
gttgctcagctctgggatttctccagtctcactgggggctgggtactgtatgtgaagactgtcccatgggtgggggatgcgtacagaggccaccacggggcagtagcagccagaagagaatgaatggtgtaaagggttgaataggggccccctcaagagagatatgtccaagttctaaacccctgtacctgtgaatgtgaccttttttggaaataggatctttttccaaataaagatcttgagatgagatcatcctagatttattgtaagccttaaatccagagacaggtatccttctaggaggacggagagggagcttcaagacacagagacacagaggagaaggccatatgaagatggaggcagagactggaggcgccattgccaagcaacactgcggatcacctgcagctgccagaggcttggaaagtgcttgccacaggccctccctcagagcctccagcaggaacccaccctgctgacaccttggcttcaggcttccagcctccacagctgtggtgaaatgaatcactgttgttttgagccacccagtttgtggcaatttgtatggcagtcctaggaaagctaacaggcagtccagcccctgcccctcaacattttgcacactttgagccctgatccagggatcttccctttccccggcgacacggctcagcactgcttccccggtggggctgcatcttctcaggacccacggctgcacggtctcgagccacagtgcctggtttctctcttgcaccaccgttggtatcttctccctgtcctatctctcacaatctgtggaagtgctttgtatgcagtgagcgcttaataaaagtcacttttctctcctcaga

SEQ ID NO: 411026 - DNA, 421 bp, Homo sapiens
agtcattgtccccagactatgagtttctgcctccttctctttcagcattctcctcccctcctctggctgtcctttgtcagactctacaatcatggctagaagaaaaaagttgacttaaccgttctttgttgaaattcgggactatgttagagataccaggtctcaatcaaatacagccttcaataaaagactcttacgtaaccagatcctatgagcagagagccatcgtgcctccaacttagtttcttcagattggctggttttggtgctcaacttttgactttacccaccttcctgacaaagtgttgaggaccactaggtaagcatgctatcttcaacgttaaaaaaaaaaatcatgattgaaggcagctgcacttcatatatcaaggagcattgaatataactaactctaaaacttcat

SEQ ID NO: 411027 - DNA, 450 bp, Homo sapiens
caccaacatctgcatctggggaggacttcaggctacttcattcacagcacaaaatgaaggggagcagtgtgtgctgagatcacgtggtggtgagagaggaaacaagagagagagaatggactcaatgggctcctgaacaaaattcttacaatggcagggatggagaccacacatctactcaacacaaagactttgcctcaggaggctgacctggataagaccatgctgtgtacccaaatggccagcagaagcccacactgagccccatacatagcaccatgctccaggcatattagcctcaatctgaggacagactgagtatattggaccccttgcagcatggagaggtcagtgatgtttttcttcctggaatacttagtgtgagtacccactttccttcccaaaaataccatctgtgggacttaataaattgcccatttaaaactaaaa

SEQ ID NO: 411028 - DNA, 370 bp, Homo sapiens
ttcacgcttggtgaaataatgtgacgctctggcgctggctaatacgtttcatgactcacacattctgcatttgccgctgccttattccttgctgacttattgcaaagggtcccaattttgacatgacacaatgccaggatccctcggtaaatacaggtttccgcacgctcttgtcaatggcacccactcttaggccctagcaactggttttggaaatttccccgatgtcagcaccacttgaatgtagactttgctacctgtattcatacagtttggctccttattttaatatgtttgaaaagaattaaagggggtattctagaacatgtccttcactagttgtgtaataaaactagaatgacaatgcaga

SEQ ID NO: 411029 - DNA, 341 bp, Homo sapiens
acatgtcaatgaatactgtagaaatttagtgacagaatcattagtggctactgtgaacaactatatgccaagaaactggaaattctagaagtagacaactttctggatacatataacctatcaagattaaaccaggaagaaatctaaaaccagaacagaccaataacaagtaatgagatcaaagcaataataaaaagtctccaagtatagaaaagcctgggacctcatgactttgctgctgaattttaccaaaaatttcatgaagaacaaatagcagttctactcaaactaattaaaaaaaatagaggcggaaggaagccttccaaattcattctttaaaa

SEQ ID NO: 411030 - DNA, 525 bp, Homo sapiens
gcctcactttttcttgccgtaaatcctgatatcagtgtttggctttgctgtgccaggtagctgggcccaagttctgtttggcaatattctcatctggttccttcctctcgtgctcaacacctcgcagtggcttccattccacgtggagtaaaagccaaagctcccctatgcacctctctgacctacccccaatcatgccctctcctcagcccctcctctccagccaccctaccctcctgctggttcctgaacacctttggcaggctcccacctcagggttcaggacctactcttatttccctgagctttcctccgcacacacccacccctacatttctctatttacccgagtccccatcaccatctaggagactgtatgttttacttgcagattacatttagtgcttaatccatggctctccctgctagtgatgtcgctgtggtcttttatttgctgatgtatctccagtgtttagatcagtgcctggtacaaagtagatgctcaataaatatttgctgagtgaa

SEQ ID NO: 411031 - DNA, 386 bp, Homo sapiens
gaacccggaatgatttcaaatgtgacttgagggtgtcttcattccacagtattgctggtcaactagagggccctgggatacctgttgtctggtgtccacacaggaggggacttcagacttctttccaactagagacagagccctccatcccaactgcattcccagaggaaggaaagtggccagtctgattacttaaaatttaacttctgaggacttttactgcctggttgtaacagcatgtgaaaatggcaggcattttcccatcacttaacccctctgcggcagggctcaaacttccctataaatactggtccatgcaattgcctggtaaaaggacatatcactattactgttaataaagccaacacaccttcccagcaaccaag

SEQ ID NO: 411032 - DNA, 481 bp, Homo sapiens
ccaagatcccacctctgcattccatcctgggtgacagaattaacctccatctcaaaaaaataaaaagctaatctatacttttcttttggtgcattattagaacatagaaggcaataaggcaaaactattgtgggtatattagtgcgtatctgtagcacctagcacagtgcctagcccataacttgtgttgaaaattaagagaaccttcttcatgacagatcatttggagaacatgttatgggtgtgggagaaaaagattcctaactctccaccccagaaataattttgctgatacaaaaatcagccagacatggtggcacaggcctataatctcagctacttaggaggatgagtttgaggataaggatacattgtgaaaaaggtgggaaaatcacttgaacacaggaggcagagattgcagtgagccaagagtgccccactgcactccagcctaggcaacagagaaagactctgtctgaaa

SEQ ID NO: 411033 - DNA, 346 bp, Homo sapiens
ccaacttactgaatgagttaaaaccctgaaaattaagtcaatgacaaagcatctctcaaatccattgtgatttaaatcatgccaagggccaaagccaagtaactttcaattattaagtaaagtgatgtaaaattttttaactttaaattctacacctcactctctcaatatcctaagggagaagaattagggtgcaattggaagccctctgaggtttatttttcatcatcaatatggataattctaatttctccttgccacttagtgtaggtgctctttaaaactgagacatctgggatcaaagcaatgccaagacaacggcatagcatgttcagatgattaaaaa

SEQ ID NO: 411034 - DNA, 437 bp, Homo sapiens
ttaactggggatggtgtcttatgcttataatcccagttactcagaaggctgaggtgagaggatcacttgagcctgggaggtcgaagctgttgtgagctaggattgcaccactgtactccaacctggatgacagagcaagaccctgtctccctcccccgataaaaaagaaattctagaatggatatcacatgtagtagaagagcataagagtggatgactggatcctgagaaaccccttacaaaggcatcaaggtggtccatgccagaagtgatggtaacttggtgtggcagtggtgatatagagaggtgattacagttgagagctcttttagggctataattaactgaatttgaaaacctaatatggagagtaatggagaaggaggtgttatgtctggttttcagttttctggcttaaggaaataggtgaatggaaa

SEQ ID NO: 411035 - DNA, 427 bp, Homo sapiens
aatgtcaatcccatgagaatgctaagtggaggctattctagaaaaatcatttcacgccactctcttcgtcagctaaggaaaaggtaaaagcaaaatgtaattctgtttaccgagtgcttccgacattttcagtgtagcactgtaacagatgatgggcaacatgtccccagatggcatcttcacaaagtatatgacacttcccaaagtatatgacacaaagtatatgacattatttcacaaagtatatgaaataatgaggtggggaggggaagcctcaagccaaataccccccaccacagcagcactggaaagctcagacattctttctccttttactttacttcatctgttttaaaaaagaatcttttcctactctaagtcatatattcagaaaactttgaaaatctaaaaataattcaaagccaaa

SEQ ID NO: 411036 - DNA, 516 bp, Homo sapiens
tgtcactaccacagcactacagcatcactgccacaaccaagaaaaccaccaccatcagaaagctcctgcctgctgccagctccagaaccatgcagcacctgcatcaacaccagtaaaacagatgacttatggcctgcctctcaagtcttaaaaatccattatgggtcactggagactctgctaacaacactatacaggagaaccaaacaacagttaaaactgcagaaatgtagcctcatttctagcctccaaattccatgtgactacatctaatttgctagatatagtttgtttaagctacatttttttttccaaatcatgactgcctgagaacctgagagatgtagtgttttgttttcctgcctctacagtacagaaaagatcactaggaggagagagaatgactgtggcatgccaccttactagagcctctccatgtcctacctgagaacttcttgttaattgagaaaactcttctttattgtttaagccaataaatcaatctgacactccagg

SEQ ID NO: 411037 - DNA, 488 bp, Homo sapiens
cttagcttgctgctaaatcattcaagtaggggctcctctttgttaaatataattttgcgggggggggcagtatacagctatttagaaactgttggtcaaagaacaggagactcaaagaggagtaaaactttaagctgttatttgggtgaaggaaataaggtatacggtggtccatttttaagacaaagtgccttgaatcggcttcggtcagcaaactacggaagaaacgggttgtactaggcccctcaggctagccgatgccttatcggcttccccgcctgcccccttcccccttccttggttgccctcacccgaaccaaaaaagtttaaaatgaaagtttactggcctgcaaaatagctcgctttgtctcttcctaccagctggcctagctacttaggtcataagtcaaatacttgaagagcccctaagcagactaagattgcaatgcactgtgggctgtaacaaaatgcagcaagacaaccctaaa

SEQ ID NO: 411038 - DNA, 384 bp, Homo sapiens
tctttcagaatgctaccatttccatgaaaaatggccgatgttagcaagctggaggataagataccatggggaggagaagcaaggtgcccctgttgacagccccagaagcagaagctcatccccagaagcacagctgcctattcaacaaacagctgaagatacatgtctggaggagctcagctgagacaaaaagaacagcctcactgagcccagcctaaatagctgaccatctcaattatgggcaaataagttttgaatgatttgttatgctgcaatagctaattaatacatgcacccagtgcagacaggatgccaggattcattgacaagttgattactagttctcttctaacagtgggcaccctataggtactgatttttccc

SEQ ID NO: 411039 - DNA, 211 bp, Homo sapiens
gcagaggtgctgatgcgattggtcactcaccagacagcatcaactaaccccaccccctgggaggaatggggtggctccaggctccttggtctcttagaagtggctcggcaccagcagggtctgtgaagtggattcctttccccagaatctaaaccctgaaagcccttctgaaactgccatgcacatggggcgtcatcacccacagacctca

SEQ ID NO: 411040 - DNA, 388 bp, Homo sapiens
gtccacggcttcattcttgaagtcagcaagaccaagaactcaccggaaggaaccaattccagacacaaggtcagacgggtccacagaaaagaaggattcaaaggactcagagcttggagtggagactgaagcaacagacaggagagaaagaagaaagatttggggcaattcgcattgggagcagagactagggagggactatgtgcaaaagaatgcctggacatcaggaacctcagaccatttgcccatttttcgacaaaaattatccaggtctcgtaagatggagaaatcaaaagtgccattttctggccatttggaaccattgttgagtttgtattggggccaagcagtattgcagaagaaaataaagcatttaggttttaagtca

SEQ ID NO: 411041 - DNA, 524 bp, Homo sapiens
caccattgtgagaatctgctgagctttccaactagtttatctgttgtttgcagtcaaagatgccctgaagagaagggggtgtgggtgggaagaattctgatttgaggtcctctgatctgggtatgatctccttctcgtctcaggaatcaggggactccatctctaaacacaggctcaagccatgtcccccagctccctctttcaaccaggtgccaccccctgcttctcttccatagacagcctcgagctgccggcagtcccttaggatctgtggccttaggcctagcttaattttttcctctccaaagagccatctgtagggccagagactggcaaagcctaacttattactggacgccacttcctttgcctgactttcagtgattcctaccttactctggggttttatgtttctcgtctcaacactgtcatttctcattcctccacaagttgaattgctcactccagccaactgaagcatgctcttcttgacacagatagctctaggcatatggttggtgaaa

SEQ ID NO: 411042 - DNA, 422 bp, Homo sapiens
ctccagcttttcctggggtcacagacctcgcgaccaccaggtgcccaaggaaatcagtcgttgaggcgaacggcttcacttcttgtcccatttgtgtgtgtggctggaattctctagcctgaatgattcatttagactccatagaccaccacctgtattcacagagtctcagaccgacttttaagatgcatttcatttttgtctcaaggttacatatctaaccagtgtgttataaagggtattggccacaggtagagaatgtatcatattccatatttctaaaatggcttatggcaattgctttaagagaattatccatgatttcatcctaaagcaaacaagtttccatttgtgtcaccttgtatttcttgtctatgtacatactcagtgtttgcattttacaataaaaccaaagatagaat

SEQ ID NO: 411043 - DNA, 509 bp, Homo sapiens
cgaaaggaagagtcaatcaatgcagcgaacttgttgttttattttaagaaattgtcacggccatcccaaccctcagtgcccaaccaccctgatcaggcagccatcatcaaggcaaggccctccaccagcaaaaagatcatgaattgctgaaagctcaaatgatggttagcttttttagcaataaagcatttttaatgaaggaatgtacatgttttagatataatgctattacacatttaacatactacatatagtgtgagcataacttttacacgtactggaaaatcaaaaaatatgtgtggctcatctgttataatgtttgttttattgtggtgatctggagccaaggctgaaatatctctgaggtatgcctgtaatgtataagtgctagtagaaatgagttgtgcagaattgctatttttttcaatttttatatttgggttaatggtaatatactaagcgtccagtctataaacttcagcattcgttgcgaaatccagaggagactt

SEQ ID NO: 411044 - DNA, 291 bp, Homo sapiens
ggaagacaccaggctttgttgtcctctttgtgggtgtaacagcatctcctctgaagctccaggtctctccagacagccctctcttccacattccagctcctgctatctcccctgctgtgacttctgcttgtaacagctagccctagactcggccaacaccatttccttcctctcctatggctcacggaagattcctgctgttgtccatccatctctgtgttgcctcccaagcctgtgtgccttacaatctttccggccctttgttaaattctattaaatgacctcacaaaa

SEQ ID NO: 411045 - DNA, 349 bp, Homo sapiens
atacatattcaaattctcttcccatttttaattgggggatttgtattgaatttagattgtttaaatgattctggataacatccttgatcagatatactatgtgcaaatatttccttccattctgtaggttgtttcttccctttctttatagtttcctttgaagcaaaaaagtttttaactctaatatggtggaatttatctttcttttttctttttttttgctcatgcttttgatgtcataactaagaatctattgcttaatccaagatcatgaagaatttcccctatgctttcttctaagagttttgtagtattaaatcttacatttaggtctttgatccacttgaat

SEQ ID NO: 411046 - DNA, 288 bp, Homo sapiens
tctgtggaaagcccagcactactctccagggtctcaggtgaagacatggccctgctattgggagtcaagggggcacgtggccttgccctttaggtttagggacacagtcctgacctggggagccctggttcattcatttactcattcgacaagtacttattgatcatctactaagtgtcaagggtgtcgcaggctccccggatacatggtacctctctgccttggtggagaccccagcctagcacgggaaatgggcactaataaaatcattccaattgggtgtaaaac

SEQ ID NO: 411047 - DNA, 396 bp, Homo sapiens
catgttcaggaggtactcaaaggtaacactggcagctgagagcaggccagtcaatgtctggccaccaccctaatcccacctggacagtcacaccccacctccctatgtgtgttcgcacagtgggggtgatgtcatgtgggtctggcctgtcctgagcagacccaggtgttgggttgtcagaaacccagtgacccatcacattcactcctcagatcatggctcaaaagtctacagagcagagacaagagattgacaaagaggtgttgatgagggcaataaaagcaaaggtggctttatcacggtgagctacttctcacaggagtcgggatccacatctgcagactacacaaaaacaaacaacacagattaaaagcacaatcaccattgaaatcaaaa

SEQ ID NO: 411048 - DNA, 245 bp, Homo sapiens
tccttcatttctctagctctttatttccaagaaggccagcccttctcttcagccacatggtatttggacagcctaggctcaatccctgcagggaaagctcaatcagccagctgagccagtcactgaacaaccaagtctggtaagaacaggggtgaagtatttaagaagcctatcgtggctggagggctaaagccttgttctcaaatcagctttataggtaataaaactgacattaaagcaaaaac

SEQ ID NO: 411049 - DNA, 365 bp, Homo sapiens
aggttaagagatatggagatttccacaaggatttggagaggagccccagtagttactaaaattctgcattagatctgtcaggaaagatagatggacttcaaggcaattgcccaacaaactgcccaagaagttttaggttataatcgagatacatcaggctggaaagtggttaaaacttcagtgcagtggtgtgcacctatagtcccagctactcaggaggctaacacaggaggactgcttgagcacaggagtttgaggctgtcatgcaccatgattgtgcctgtgaatagccagtacactacagactgggcaacatagtgagaccctgtctctgaaaaatatatatatatttttttttcttttac

SEQ ID NO: 411050 - DNA, 838 bp, Homo sapiens
tgaactgcaaaacaagaagggaacaataaatttctgtggctgataccacatctaaaagattagaacacttaacaaggaatttttaaagaatgtaagaacattgaaatcagcacttttaacaaacgtttaacgcagggctattttctagataaactcaaaaatttgtcaaatgggacacgatgcacgattctgtattcctactctgtggagtttttatctacctattgggacttcttgccctttttaaccccctctcccctcccacacgcatattatacttactgatatttgccttcgtttactgaacagatttttttttggctcctattgtgtgccaggtactgttctagacgcctattttacttaagtgaacaaaataaaaagctttgccctcatggagcttacattctattagaggatgcagaaaataaaatatataatggtgttagaaagtgatggtgccatcaacaaaaaaaaagagaaatataaaggagtacgggaaagttccagagtggaggtgggaactggtattttaaagatgacggtggtcagtttgagcctcatttagtaggtgttatttgagcaaagacttgaaggaattaagaaaatttgctaagtaaatatcaggaagagcattcaggcagataggaaagccaatacaaatgcttttaggcctgtcatgtttgaggaatagcaaggaagccagtgtatctggagagggatgagcaagagttttgggggtggagggacaagaagataaagtcaaagagatcatggtagccggatcattgtaaaggctgatagaagccatgggagattttgaatagaggagaggtat

SEQ ID NO: 411051 - DNA, 454 bp, Homo sapiens
aacttttaactttgaaaaccgcaagtaatatttttcttcctgaaacctctgcagtggtagcaatgcactgaagtttgattaaaagtttactggtcattcctgccatgagaagatgatagagaatatcaccacagtgtgacttgcttccaaggcagcatggtttcatgcagaggatctaaactggggaccatgtgctgggctgcaaaagggctgtgcagtgcctaaaatgttatgcaaaattttataaagcctcgtctttcccttgaactccataattatgtatgcaacttcatcttcagcatcttcagttggatgtctaattccaaactgcacatgtacaggagacgttttgaccgttttcccacaaacttgacctatccacaggctttttcatctctgttttggcatttacataggtaagaataaataaatatatctctgtgcaatcatcaag

SEQ ID NO: 411052 - DNA, 352 bp, Homo sapiens
gcctctttccagtaacatctgatttctccattctcaaactacacttctcagggaaccagatatttactctcgtctgggaagatgcctcttatgttttccttttacttcctggttatcatgtggttgcattttccaagttcttatcattgaatttatgagagcctatccaaatttattttcttttattttctaataattgaaatgtgagatgaaaataacatttcacttatgaaaaacgcttctcttgatgaatccttccatgtgttagttatctattgctctgtaacaaaggtgttagttatctattgctgtgtaacaaattaaaacttaatggcttgaaacaaatatttgt

SEQ ID NO: 411053 - DNA, 593 bp, Homo sapiens
cggcctcagccctggagctgaaagtgtggctggagctagaggtggcagagagggggtgaccagcacagctccagccagcagctcccacactgctcccagtcctgggcacagtggaagctatggaggcagagaccagggtgtgcaacctgggctcctctgcctcactggagagggacttctctcattcagcagagcagcagccctgctgctgaaggccctgctgctactgctgctgggggtgtttgcctgcctgcaggaggtgctggagagcaagaaaaggagcctgtgagcaggggttccagcaggtcctccggctcccagaggtgacctcctcctccaggaatggaggtttgccctcagctgggcatctgggccatttgcctctaatgtgctgcccaggatggcctcttcttgacaggtggacaggggttgagggggccagggggcatctccaaaggaagctcttaaactcagcagcagcactccagaatctccatgcctgcacctgcccaaggatttattcatagcttaactaagaatttcaaatttctaccataacactgaaataaagtttgactttttgaaacttcaat

SEQ ID NO: 411054 - DNA, 671 bp, Homo sapiens
atctgggatggagaaaccccctttgaggccaaaagcactggcttaattctgttaattctgatctatgccaccccagtgctgaacgtctcctctcagagtgctcagcaaatacacagcccttcccatgcctcaatcaaggagggaggcccctctctgctcactgggaagcctctgggtgcttttctgctctggctcggaagagtccaaataagccttcccagctcactgggcagacctcagagtttctgctaacttagcagggttttgaggtctgtcccagaggatgtggctggcagggtgtgaagacactgggcaaaatccttccttgtgaatacagctctcagaggcagccagcctcagtggtggattcagatcccaggctctgcagggagatgtgattcagatcagctggtggatcagctccacgctctacctgtgatgtgatccccgccaagttactcaacttccccgagcttcagttgcctaatctgtaaataagactaataaagcctagattggcgagataacgtgtggaagactctcaacacagtgtctggaacatgctgcttttaagggaaatgtgattttgattatggttgaggccatttctcaacatgtagacataaaatgcggaaacatctaagatttcaataaagcaatgttttgttagt

SEQ ID NO: 411055 - DNA, 341 bp, Homo sapiens
cgtgggggctgaggagggtctgagctacattttaacttcaagatgagccagaggaaagcagcctgccagtcaagcccccaaggcaggtatgcacttctcccaaactctccgcatggctcagcggggactggggtccatggccgggacagactctggaggggccaccagggggccaggaaaggagggcagagcctcactcaagcctggttctcccgcctcatccaccccaaagacccttgaccccaaaacgaacatcctggaaaacaaatcaggacactacacccaattccactataaacaaccacaaaataaacccaggcccttatgctgacggtgctaaa

SEQ ID NO: 411056 - DNA, 373 bp, Homo sapiens
cattgctccttggttttgctgccctagatggagatttttaaagtgcactgtactaaaaccacctacctagaatcttccccatcttcattcttaaaacacttttctctccacttggcttctgggataaaagttttctgatttatcttttatcttattggctactgctactcagccaactttgctgtttcttcgtctttgtcttgatctccagatgttggtaaatcctgtggattggtcttcaattttcttatgtccacaattcatattcacatgtctaagtaaggtcaaccattcctgtgactttaagacaatgcatatgtaaagcccatttttttaatccccagattttaccttttctatcaaattcagacat

SEQ ID NO: 411057 - DNA, 607 bp, Homo sapiens
gctttcatgagaacagtttgctgcttacttacacagccaccagtgatttactgagttgatcacgaccctcactctttcggcctccaacaaaagacgatcaaagaatggttgtttgcagaggttatggacaagacttgatgtccaggccgagtgtccgtatgcacaggagcctcttggtggtgcagagtgaagccagaggaggaggagtgggttgtgtccatgggctgattctccctgcaccaacaggacagaatcctaaggaatccgagcatttgaaattcaaatctggtcttacaggttgttatgtatttgtctaggtaggaggctagaatgtattgaaatggggttagcctgacatatttatatatttcatatttaggcttccatttgttcctttgtcttgggtcccaaaaatatattagaggtgggcctgtctgttctcttggacacgaggacctcaacgagtttccactgttctctgaatgtttccttcctggttttctgtgtatacaataattcctagttttctgttatttacaattttacttccactttttaaagacaaaaatgtatgtttttttagtcaatattgatatagtggaccaaa

SEQ ID NO: 411058 - DNA, 518 bp, Homo sapiens
aaatgtatgttcttcctgtagattacagtcatttttaagtatatttagctatgattatttacagctcatgtatcatatgtatgattaattttaaataattaactagaaggcattcttagctaaaatatagatttttttatatattaatttgccatatagtttattcagctctaatttcttatgtcttaagatatattttttaaacagctatttagctctaaaagtacttcagataagtgtgcttattggaattttttatagaaaaataatttttttcagtgtgcaatataatataaataatgatcaacctgatacagattttataccttgaatattatatataggaaagtattaaatatagaaatgagcagttttccctatagctatttatgggctattattgaataaaaacaaaagtactttaaataataacaaaagataagtaagctcagatgtaaacttttctactcaagatttggcttctttaaatgcaattctgtataatgagcaaaaaaaaa

SEQ ID NO: 411059 - DNA, 449 bp, Homo sapiens
atctgtgccaagaggagtcatgagaagaggtttctgcaccagcctaggaaagttgagatgagtgcccttaggtgatcccgtgcaagggaggcaccgccttgggttgtcagtcattggaagccgccctagccacagaaatattttgtcagatttccaacagggctatggcaactgagggcatagtctgtaggcaatggacatggtattcgactcagtattcttgtttcgtttatgatacaagggcacgttttccagtaagttctattctgagagagtgagcgagaaaggacggatctcccggttgactggcttcggagcagatgggacacagcagcttctgaaagcctcctggttctcctgcaaataaatttctcagatgcatatatttagggaaacaattcatcaatgaagatgacaaaaccatctggctctagagacttaaaaaaaat

SEQ ID NO: 411060 - DNA, 1072 bp, Homo sapiens
tctcaagttctcttaaaacagaaaaaaaatgttattggctgaatgtggaagtgcattagacttctattatctttcagaaaggaagagtagcatatttatgtttcataaaattctgacaattgttttatagcaattgatataatttgatacaagtagtgtatttccagttttttgttaccaatcatgtcctttttgcttttagcaatgaaattatttcccatataacattttcccctcctccttctgaaagtaaatgtatttatgaaactgtggcttggcaacaagaaaagtaaaatgatgtgttttcttacttcaagggagccaatggggtatagtgtactagaaagagctctggactgagagcaaggaaatatgagtgccagttccagctctgctgtaatgtaaatgtgttttaaatggatggatcagtgaatagacaaacaaattctttggacctcagtttcccaattatcaagtttagaacctggagtagattatgtctatgtctcctactaccttaaaatctcattccatgtaagcaatgtttcccttcttactataatcctttgtagtgaaatggtcatttcaaggattgttataatggaacacatttggtatgtgttaatgtagcgacacttcacctattttttattgctaatcgatctcctacttagaaacatcccttacttaattacacaggaagtctgtgattggagggtggggtaggggtttgggtttttaataccttttctcatgctctaccatgggaaattagtttccctggattattttggcccaaatctgaaatagaaaatttgcatacattttcatacctatcccaaattcatttcttactttaatgagccatgtagtcatgcattagtttatctacagaaaaccttgctttaatgttttaaaaccaaaacactcaaactcatgcttgatgagcatttcccatgcctggtttaccctgtgtgaaacttccattcctgtaagtaacctgcccgggaaaagttttgaaggacaaagatcaaccagaatgagaaaaagctaagttgaggaaaaaaaaaaa

SEQ ID NO: 411061 - DNA, 580 bp, Homo sapiens
tgtccccccaaataccaccacttgagttcatcagatttcagtttgaatcagtaacctatcaaaatgttttatgctgctggactcaaagtgacccagaagattctcaatttatttccatccaggtacagaggtatctgcatggtaaataccacctccgcacctggcacagcctggcattcttgtaggagcctgggcaaagagccctggaactcaatggagcaaagagagtgaactcctctcccagaggtcatggagaagaaggcaaagcaggcctgtcacattgtccccagcctgccaggtgccactgcagcctcggaaagtttgtctaggccaaggcgctctcctttgctgcttctgcctgcctcttagtgtgggacctcccagggagatgagaaaggagaggaaggactcgtatctgttcagttctcttctcccctgtgcacattcactttacatcccctccctccatgacatcttctcacacaggctctctgctttgtttactttttttttctggcaatcagccttgaagagagattttacaatatttggaaatattttataatatatgaaaaaaaat

SEQ ID NO: 411062 - DNA, 282 bp, Homo sapiens
cactgtttaaagaaaaaaaatgaaaacgcttttaagctatctgaaattccaactctaggcaaaattaaaatttaaaattctaactaaagtaacataaagaatatggcactccttagggactgagaaatttaaaaataaatgaaaattcacttcagttaagaagtgatttataaggggtccagtgagatacatttcaaaggaaagagtagtgtcgctgcggctgctttatcagacagaagggaaaatatccatccctacagaaaagaacttcagaaaaaaaaa

SEQ ID NO: 411063 - DNA, 481 bp, Homo sapiens
tgtagaaagactttaattttttaattcaagaggtagtttccaaaaaatcttggaacacttgattatttttaacagttaattcctaagaattagaggtcttactctctatttttgttaatatgtgggcatccacaatgtaatactttataatctaactacacggtctcgaattattgagaacatccaaagaagtcaaataagcagttgtttgtcttaaaattctggtgaactttttttattgggccttagactcaaactggcacctcaactttaatgactgtctaaagtcctattatctgccatttgtattataatttctccttgccttaatggtgtattttaatttttaactccaccaggtgtggtggcgcatgcctataatcctagcactttgggaggctgagccaggaggatcacttgagtccaggagtttaagaccagcctgggcaatacagcaagaacccctatcacaatttaaaaa

SEQ ID NO: 411064 - DNA, 408 bp, Homo sapiens
tgggaaatttttcaaaccttcagatactattgattctgaaaactaaaatagtactttgctaatgttggaagtattgttgttagagaacaacccaggaataaatgaattttaagactttagaaattctcaacaggcaaatggacgcttcctgccccagtgattctgataatagctcctcagttttgagaattgctgttcctaataaaaatgtgtcaaatagcttagcatgttgggaaaagaaaatggttgaggtccccggtctagactggagcatttggtgcttaataatttttttgtggttggacaacttgggaaatttgaaggatttggatcctcaatccagaaaagtgtttatacgcctatgcactttaaacaaatgcgaataaagtctagaaggctgaataactg

SEQ ID NO: 411065 - DNA, 455 bp, Homo sapiens
tataataatgcagaggtgaatgaaatatagaacaagggagctgtaaaagacaagattgagagactcaacacctctgtatgttaatagatgccgtaaacaaaagacaaggagcaggctggaagaaatacatataaaataaagaatttggggccaggcagggtggcttatgcctgtgatcccagcactttggatggctggggcaggaggatcatttgagcttagattagaagttcaagaccagcctgggcaacataatgatgcctcatctctacaaaaaaaataaaagaagtagctaggtgtggtggctcatgcctatagtcccaactactttagatgctgaggtgagaggatcacttgaggaagagaggttgaagctgcagtgcgctgtgattatgctaccacaggtaggtctcactcagcctgagcgacagagtaagaccctgtctcaaaggaaa

SEQ ID NO: 411066 - DNA, 577 bp, Homo sapiens
caaagtactcacaatgtatacatagagccaacaaaggactcagaattcctactaatcaatacaaaaagagcacaaaaaaataagcaaaggacttgtacaggcacttcaaaaatgaggctatccaatggccagtaactacaagaaaggtgctcaatctcttaagtcatcaggaaaatagaaattaaaagctcaatgacatcttgttatacacatctacaaaatggctaaaattaaaaagtgacaatttcaagtgctgacaaaaatgtacagcaatgggaattatccttagctggtgggagtgtaatttggtacaatcactttggacatgggcagaatctactaatgctgaacacacataaaccctattaatcagcaattctacttctggcttatatccaacagaaatgtacagaaatatagagcaagcaagtttaagaatgttctgggctgggcgtggtggctcaagcttgtaatcccaacactttgggaggtcgaggcaggtggatcacctgaggtcaggagttcgagaccagcctggccaacatggtgaaaccccatttctactaaaaatacaaaa

SEQ ID NO: 411067 - DNA, 401 bp, Homo sapiens
ttaaagccagtattatacatataatatgaaatatgtgtatatatacatatttcatatgtatatatataaatgttgagctatgctcagagagctaaacaccttaattgatctagctgtatatagcttctatctggaattcctagcagagtaaattgtgtacatgtacaagagcaaagtacatatgcaggtacatcacttcctataggactctgagtaaagcattagaatatggacatagacacccacgttgaatgttcaaagagcaaaaatgctttccctaggtgatattgcccaccctcgtccatgtttctacctccagaatggacctgccatctgtctatctggttgcacagaccaaaacctaggggtcatctcgatacttccttttcctcactgtcctc

SEQ ID NO: 411068 - DNA, 377 bp, Homo sapiens
gcattgcgccctgtcctgtcatgtgtcctcaccggggtatcggccgtcactcagctctcctgtgcccctgcgtctcaacctaggcgggctgggcggggcaggcctcctttgttctccacaatctactgtctccgagtgtacacgttgcgctgtttgtgtttgatccccctgacttgtagccagcttgtgtaagatcccttgcagaacgagaaagttaaaaacaagcccacccagtactcacaccatcaaatctgttatagagtgtacgactgtattaacacggaggcctgcctggctacttttttaacatattgttaagtaatattaaaatcatgtctttctttttgaaagatggaatacattagtacagcaggaga

SEQ ID NO: 411069 - DNA, 249 bp, Homo sapiens
ttatagtttcttggctggaaggcacaggatttggataaattgagtttatcctgtagacctcatctacacagtaaacactctcttagcccagaatcagtgttttctttaagtttagagagatgcttgtgtacagttctgtggcagtctccatctcatcctgaaaacactttatctattttaatatcccaagactgtctgctttcctgagtttgtaacacatgaagaagtcagatactcattaaaaaaaaa

SEQ ID NO: 411070 - DNA, 332 bp, Homo sapiens
agcactacattaaatatttgctgtattatttattgattactctccatggaccacgcactttatacacattacctcatttaagcgttccaaaaacctgtgagataggtattattagttccattttacctttgaggaaattcaagcccagaaagcttgaggaattttttttaatccctaaacgagtaggtgacaaagtagggatttaaactcaggcccaattctaacaactctgtgagacactcaaggaaggtcacaggcacccctgtgataagacctaggcctctttcatataccaacataagatatacttcgattttaaccagttgcacgca

SEQ ID NO: 411071 - DNA, 5373 bp, Homo sapiens
ccccgcgccagggcaagtccaccctcctggagatcttacagacggggagggccccccaggtggtgcatggagaggccaccatcaggaccaccaagtgggagctccagaggccggctggctcaagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacggccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctgaagcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaac

SEQ ID NO: 411072 - DNA, 5521 bp, Homo sapiens
ccccgcgccagggcaagtccaccctcctggagatcttacagacggggagggccccccaggtggtgcatggagaggccaccatcaggaccaccaagtgggagctccagaggccggctggctcaagagccaaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacatgagatttcctgcaagagcctggaaggtcaggaagggctgcgacagctgattttccacgtcacgtgcagcatgaaggacgtgggcagcaccatcggctgccagcgactggcagggcggctgatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccgccctgacggccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggaactacacggtggtgaacacagagaagggcctcatggaggtgcagaggatgtgctgccctgggatgaaggtgagctgccagctccaggtccagagatccctgtggacagccaccgaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctgaagcccagcggggccgagtcattgccgtcttaaaagcccgagagctgactccgcatgggattatgccagtctcctctgtgaaggtatgctgggcagggtggcctgtccgggacatggtctacatggctgcagtgatgtgaggctggcgccagctgcagctccccacagtgtttacaccccgcactttgactaccgagccccacacgggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaac

SEQ ID NO: 411073 - DNA, 1993 bp, Homo sapiens
acccctaacaggctttggagccagtaccaggtgcacacacaaataccacagagaacttctgagaggctgtgcccccagatcccaatgttggttttctctggggaatagattacgggctattttctgtttcctctttagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgccccttaaacacaccccaacaggccttggatactccagctgtcgtcacctgcttcttggccgtgcctgttattaaaaagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggcgcggtggagatgttatcgtcattggcctggagaaggattctgaagcccagcggggccgagtcattgccgtcttaaaagcccgagagctgactccgcatggggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaagcttgcagcacagtgcgtcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttatgaaattccttctcctggctcatcctggctcaaaaagctcccccactgagcacgttgccacccccactcctgcccgccagagaacaaaccccctttttcctttacctacccaaatcttataaaacggcctcacgcctatctcccttcactgactcccttttcggactcagcccacctgcgcccaggtgaaataaacagccttgttgctcaca

SEQ ID NO: 411074 - DNA, 671 bp, Homo sapiens
ttttttttttttaagaaacaggttcttgctatgttgcccaggctggagtacagtggctaatcacaggtgtgatcatagtgcatagcagcctcagactcctgggttcaagcaatcctcccacctcagcctcccgagtagctgagagtagaggcgtgtactgctgtgcctggctctagactttttcctgaactcctctcctgtactttatttgggttagaagcagcatggggagacttctgcagcatggctctttctgggggctcaaaagcagaagttcctggtgagctcacgtggtcatggaggacttcctggaggaggtgatatttttgctggccttgtggggaaggaagaaaacatgtcagaggagagctgaatgagaaagtacaggagcagaagcaagggccaggtccagcacgtaaaggggaagacagaggtaggcagggaaagtttggatcatattcttcaggcactggggagccactgaaggttgttcggctgggttagggctgagttggggtagagtctcctggggtgtgtgtgtgtgtgtgtgtgtgcaggagagggaacaaggagtgaagtaggaaattcctgggggtgagtaagctctcttcatatagaggtccttgggcccaggctgagaccctcggctggcccagggaaggaattgcccg

SEQ ID NO: 411075 - DNA, 497 bp, Homo sapiens
ctagtggtgtgtaaggtgcttgtgttgtgaagagtaattttacttgtgtttaaatttgaaaggtgatgcatataaccctgctttccccccatttctctttcaatgcaagttaacttacacctccctttaaagaacagcatgccaagaactggctgataaaatgaaatatgttcctaccctggtggctgaggacagccaactccttccagtctagatgatgctgggagaagtacttgatgctgctacctctgtgagctacttggtataccagtcagttgtaccatggtccccagagggacctgcagaaagctggaagtggccaggctgacttggtgggtcaattgaaagtgtgtaaagtctgaatgctcttggtatatggttttgccatttttgtatggtgtaaatctataactattgttttaacatttattttggaacagtcccttttgtcaggaaatgagctaaaaaagtaaagtttaataaaaaaataagtagca

SEQ ID NO: 411076 - DNA, 335 bp, Homo sapiens
taaaatagtcagattctagaggaagtagccagtacaagccggatagagcaaatatgattaactatttttgccaatctttggtgacagtggtgcataggggcattagagaagcagcaggtataatctttgaatggatctgggcctttagtgttaaggagtccagactagaaaagctaggtgaactgtgaaaaaaggataagtagggtctaagagaagatccaccaggtaaacctagaataccagaggaattacctaggatgataggaatgtaacatttcagagctgtgcttaggaaagaagtatatttttcactgaacaagcaatgtttacaattg

SEQ ID NO: 411077 - DNA, 378 bp, Homo sapiens
taatacctacctcacagggttctgtgaggctccagtgagctaaaagcaacataatgatgacgatgaccaatgatgatgatggtggtggtggtgatggtgatggtgatggtgatggtgatgatctgtctccacagcagtcaatctctttgaacgaattacaattgtggttgttgccaggaagttaggaaccacctgctgtctgtaagctcaagcccaggtccaactttgtgtggggcttagagctgatgaacaggtagcagagcacacaggcggtaacaatgaaggcgagaagaaccactgctgctacggacaggcctatgagagcgccaatgctgagccaccacatgtagctgtgctcgtaggggaagaagctgtgcg

SEQ ID NO: 411078 - DNA, 464 bp, Homo sapiens
tttggtatggagacatttattgaatgtttatgggactggtccacataggtcagggttgggtacagaggcttcctcagggctgcctggaatgtcactggtggtcactgtggccatgaagcaatgatggaggaggcgtttggagttcacagcctgcccctcattgctctccagctgcgggttcaagcaggagtaactctgctggagagggctcacttttggcacttctgccgccatgcctgtgttcacaccttggcagtcaggagaaacctcctcagggcctgctgtctgtaagctcaagcccaggtccaactttgtgtggggcttagagctgatgaacaggtagcagagcacacaggcggtaacaatgaaggcgagaagaaccactgctgctacggacaggcctatgagagcgccaatgctgagccaccacatgtagctgtgctcgtaggggaagaagctgtgcg

SEQ ID NO: 411079 - DNA, 420 bp, Homo sapiens
acttatattccgagcaccgatcatgaccctactaatcaaagcaggatgcagcaaagacaccagccgaaaccagcggatagcaacaaaagtgaccctcttgccctcactgctaataagcataaagacagtcccaccagtgccatgacagtttacaaatgccatggcaacaacccagaagtttccttatatggttccaggaactcccccaccccttttctagaaaattctgaataacctactccttaaatagcatataacgaagactgtgtataaatatagctagccagcaatccataaggactgctgctgctgctgctgctgctgctctgggcagctctgcctatgaaagaaccctgctctggggagcagccactttgccatacactgttgctctaataaacttgccttctttcattgcca

SEQ ID NO: 411080 - DNA, 572 bp, Homo sapiens
cagtttagggcgttgaaacttgagctcgttctcatacatagaaaaatgacttttccagctatatccctaagtgtatcattgctatagtttcttacctatctcctagaataacttctgttccattattaataataatattgttactttaagtcacaggaatctgtgttgaaatgactgtccctttatctagttcccatcagaaagtatttactgagttctctttggtggcatattactctactagattaacagaataaaataatgaagaataatcaacatattttctcctctctaggcattaacggtttaatagctaagatagttatgtaaattcattaaagtaattttcaggatcatatgtgtactgagcttttacaagatctcttatatactttagtttcttatgctatcctgggaaagtttgtatttaaagatttttacctttttgtcccacaaattcacaaatagcgtacattagttatgtgcagtttttttgtgtataaataagacctcattgaagctgggaaaaatattaatatccgctccccctaccacccttataaaaaaaaaaa

SEQ ID NO: 411081 - DNA, 452 bp, Homo sapiens
gttctggctctgttacccaggctggagtgcagtggtgtgattgtggcacactgcagccttgaccaacctcctgggcacaagtaatcctgcagtctcctgagtagctgggactacagcacacacacccagctaattaatttttttttctttttttagcggggggcggtggggtcggggaggtgccgggtgcagtggctcacacctgtaatcccagcactttgggaggctgaggcgggcggatcacctgaggtggggagttggaaaccagcctgaccaacatggagaaactccgtctctactaaaaaatacaaaattacccgggcatggtggtgcatgcctgtaatcccagctactcgggaggctgaggcaggagaatcgcttgaacctgggaggcggaggttgcagtgagccgaggtcacgccactgcactccagcctgggcgacaagagcaa

SEQ ID NO: 411082 - DNA, 412 bp, Homo sapiens
gatgttttattggttttattttgatctccctggaattaaagttagaaatggaagatgctccatgctaacatggcatgtttgccctggcataattaatagttgtttttatttttgtttaatacctagttaactcttgattctttgggatcaaattattgaattctgggttgtccaaggcttttttttttctgcccccagcctgcctcttgtcagattgagtaaaggaagataatgacaggatatgcaaatcagccagtttggctatggttaacactgctgggtcaaactataaaaaataaagattgagaattatctgagtattttgtttatacagactttcagttacctatattaatgtgggcattagtcaagagttaactatgtttgaatttactcatttcttaaaaaaaag

SEQ ID NO: 411083 - DNA, 435 bp, Homo sapiens
tctcggcctctcctcttaactcttttgctaaaatgctttaccaaattatttggcactaagaaaatgatttcctgactgttgctagaggccctgctagcagcttggaacacataatcattctcatctagcagaatataattattggtataattctgagctactgtaatttcattctactaaaaaatcgcagcatgaatttgtaatatcaggaagactttggggctagagaaaataaaatgtttggaaaaatgctgccatatgtacaggattcaagtggcatctgcgtgtgctcattacaccacatcattctgtatctgtccaatttgttcctcaggtaactcaaatgactcatggggttggaactatgatgttctgaaggccttcagtttttgcttccagcttatgcccaataaagcatttttttattattctgcg

SEQ ID NO: 411084 - DNA, 333 bp, Homo sapiens
atggaattggtctgactccatattactccttacttagatgtaaaacaaatacacatgatttttcatcctagaagaaagtctaaacgaactcttgacaaaaacagccaagttcagagaaagctgactctgttggtgtaagaagcgttttttcaggctgggctgctggctcatgcctgtaatctcagcactttgggaggccgaggcaggtggatcacttgaggtcaggagttcgagaccagcctggccaacatggggaaacctcgtctctactaaaaatagaaaaattagctgggcgtggtggcgcatgcctgtaatcccagctacttgggagac

SEQ ID NO: 411085 - DNA, 482 bp, Homo sapiens
tttttataccttgttttatgggcagcataagttttgtgcatcacaagtatcaactatcacataaaaccagttgaatgttattcacagatttggaatctatttgtgtgaggataattgtacaagaatgtgaagatgaataatgtagcatacagttgcataattttagatttctgttttactctctttggcctgtttgcaaaaataatccctcctttaaaaatgaattaacaacacataaattacaagcagtgaaaatccatagattaaaaaaagacttaaaatacacagttgcaatgtctggcccttaagattatgatatgaacaagaaaactataaaacatgattttatatgtcgggtgcagtggctcacgcctgtaaccccagtactttgggaggccaaggcaggcagattgcttgagcccaggcattcaagaccagcctgggcaacatggcaaaagtccatctatctctacaaaaaaaaa

SEQ ID NO: 411086 - DNA, 349 bp, Homo sapiens
attttaacttatggccaaacgtggctggtgcctactctattggacagtatagctctagggaaaccttcattaatccagacctcaattcccacaggtaaagttatgagattagaaatcacttttaagaatcacatccacgaagaaacaaggcatcttgaaaaagagcaggcagaaacagcatagtcggatcagcaaggacttcagaaattggaattgacagatgtagaatgtaaaacaaaagcagaaatagaaaatatgactaagagcaagacaccatacaaatgaccaagcaggctgggcatggtggctgacatctgtaatcccggcactgtgggaggctgaggcagat

SEQ ID NO: 411087 - DNA, 1526 bp, Homo sapiens
agaaagactcaggacccacttgaaaggtctcccactagtcaaagatgatataatttgatttaaaaaacaaataaatgattaaaacacctaaaatatgttaaaatctgtaaggtcataatgataatcataataacaaacctggtagtcccttttataggatgctagagcaccaaatcactattcacaaaactgataaataggaagaagtaagcatttaccctgttccctgtacaaattatacttcaaagtcaccaattaattgatgaaagaaaactttacagaagaattgtaactaatatattagaaggattatagaataatattatcatcatttgagtttcaacacattcattaacccttataccacagaaagatgcaagaagagcaaaccaccacctctggggcatccttgtcaaaaaattgaacctgaatctgatcaagtctctagttagaactactagtttgcaagaaatacagagggcagagaaacatgttaaatgacaccataaggctgcaatcacaaaaatccaaaatgtgagaaatgctacaggacaaagaacccagtttctttaacaaatgaattgcaaggagaaaagaaagaagagtatgctgtgaattaatagatttgaggaacatcaaataaaatgggtaccttgtttgtgtctttatccaaactaactgtaaaaagttattcaacaattgagggtatttgatgatattaaggaactgatgttgattttttaggtgtgatagtattgctgttattttaatttttaaaagccattatcttttagaaatgtattctgatatatttatggatgaaattatataatgaaataatccaatgtgagtcaacctgtatctatcaagtgtaatcatcttagcttcagtaaaatacctagtaaataatagatatattattttaaagtgaatactgaaaaaaatgctcagctttaattttgaatatttatattaatagatgtaacccacataaacaaaagctctttggggtgtccacaatcatttttaggagtgtgagtgtaaagtaccctaagaccacaaagtttgagaaccactattataagacaattgaaaaaaataagaatgccagcaggaattattgtcttatagactcatgggaaaagtgggaggatgatagtgaaaatctggtgagataatgtgtatgaaaacacccagcatggttcctggcatgtagcagttagttagtaaatattagttaaatctgctcttctttccagccctcctctgtgctttacagaaataaggtgcctctactattgtgagtcagattagtataaactatttaggcacagggtttgatgacggtcatcgaaaccctgtcatcaaacccttcatcgaagcaatataagaaggccccccaaataaccgcgttaattggctgtagtggtctacttgtatagggtttcgatgacggtcatcaaaccctaaattcaccaagcgttggattgttcacccactaatagggtttcgagtgccggggtcct

SEQ ID NO: 411088 - DNA, 258 bp, Homo sapiens
ggccgcaagataacatggacgggcttaacagcactcaactctgcgcttcaaagtggttcagcgagctcattttatgtcacatgtatttcaccacgatttttaaaaaaatcacatcaaggaccattcatgcattaacagaagactgctggggccagtggagccacggcctgcctatctgatacccagatgccttgctggggagagaaccggagtttccgcgaaagcgcagaagtggacacttacggagaaattcctgtc

SEQ ID NO: 411089 - DNA, 331 bp, Homo sapiens
ttttaactatacctttgcaagcctctgttaagatttttaaatggttattctcctcaataataatcaccaaaatgccatcaggaaaatgcatttttctttgttgtcatggtaaaatacgttctgaaattgtttcccattatattataaagccaattataaaaaaccttgtaaactgtacatggcatatggatgaaaatcatgctttgagacaatttgatggaaagttatacttgtttcttttaggtttttgtttcatagtagggtctttcagatttgcttctttctgtcgtcttttgctcttgcttttatttagaaattttagatatacaaa

SEQ ID NO: 411090 - DNA, 231 bp, Homo sapiens
tttactctgcttggagattattgagcttcttgtatgcgtgagtttatggttttcatcaatttggggaaattttcagccattattttttcaaaaaaaatttcttattcccctcttctgggacttaaattccatgttaaactgcttaatattgtctctcaggtaactgaagctcactctctttacctctctctctttattttttgtttctttagttgtttttctctagacagt

SEQ ID NO: 411091 - DNA, 540 bp, Homo sapiens
tgtttatgttaagactcaaaaatgtccgtattatcctcatgtaaaatccttgatgctgatcattttaatatgcatcttgtcctattgcttcccacctcaaaagtaaaattcttttgaagttcacccccagtgtacagaatggaaggtaatagaattgggattcaaggttattttaatatttgatacataagataaattgtaatagaagcagataaattgtaatatgaaagccacttagcaaaagttaccacaatcaaagtcaagtgcataatgaatatagtcttgcctttaactcttatactttttttttctcttcttactcagtgaacttgtaaatataactaactggccatggtatctcccattgaattatttaaaattatcttcctctcaaattatttttttgggtcttggcttagtctacaatttctagagttttagaactatataataattaaattgcatttttttaaaaaataaggaattttgagggaaaatattaaagtggactttggggaaaaattcagtggaaaaaaagaa

SEQ ID NO: 411092 - DNA, 381 bp, Homo sapiens
tgctcaggtaataaatcaagtttgaaaaactggaccgtattcccagcataatctgtatgctatatgatgcttcacaggcggatctggactaagaagtaaaggtaaatgggattattttgatgattagagtaatgagcacaaaggaaatccctatgtgtgtgaggatgaatttagtttctttctctaatggagatatttcgggcacatgcactttctaaatagatctaggatcagcactgtgagaggaaggccacattctctaatgtcctcagtctaggtccttaaatgtctcatttcttttttcttcaaagggccagatagtaaatactttgggtttgtgggccatacagtttctgttgcagctactcaactctgccatta

SEQ ID NO: 411093 - DNA, 224 bp, Homo sapiens
ttaattgagaaaatataaaaatggccactaatgcttttgataagcatgagatgggccatgtcaccataccctctaatatccaaaggtaggatattcacttgtgtcatctggactttgccgacacagtcagttcttttaggctttctgcaagatccacaaaaccttctttgagactctttgctcagatgtgcttccaaattcagaaatgtcttttagaaaggtaa

SEQ ID NO: 411094 - DNA, 251 bp, Homo sapiens
gataatttagatggaatggaccaattcatagaaaagtacgaattaccacccaaaataaatagataatttgaatggctctttaactattaagggaactgaatttataattaaaatactactaagatgaaatcttgaggctcaaatagtttcaccagagaattctaccatacttttagagtcaacaccagttttacacattttcttcctgaaaatggaagaaagagaaacagtttccagttcattttatgaga

SEQ ID NO: 411095 - DNA, 349 bp, Homo sapiens
tttttttttgagatggagtctcactctgttgcccaggctggagtgcagtggctccatctcggctcactgcaacctccacctcccgggttcaagtgattctcctgcctcagcctcccaagtagctgggattacaggcacatgccaccacgcccagctaatttttatatttttagtagagagagggtttcaccattctggccaggctggtctcgaactcctgacctcaagtgatttgcccaccttggcctcccaaactgctaggattacaagcgggagccatcgcgcccggcctgacgcctctttctttagtgtgtagctggttttcttctccccgacttcacatggtctt

SEQ ID NO: 411096 - DNA, 516 bp, Homo sapiens
caacatttgtagcaagagaaattaagaagaaccatctgatcgctgtaaaaacaagactggaagcaacacaagtatctatcagtaggatacacaatagtacatctacaaaatgaagtactatgctcctataaaagaacgaaggaatatttcttttttttttttttttttttttgagacagactctcactctgtcacccaggctggagggcagtggcgccatctcggctcactgcaacctctggctcccaggttcaagggattctcctgcctcagcctcccgagtagctgggattacaggtatgcaccaccacacccggctaattttttcaaaattttttttagaagagacaggatttcaccatgttggccaggctggtttcaaactcctgacctcagttgatccacccacctcggcctcccaaagtgctgagatgtcaggtgtgagccactgtacttggcctagaatggaataatattctatttcttgctataaagtgcccttataatgtagatggc

SEQ ID NO: 411097 - DNA, 90 bp, Homo sapiens
tttttaacttcatagcatccatcaagatagtggctgacacttctgctgtaataaaactggaattaaaaaaaaaaaaatctagaggctttc

SEQ ID NO: 411098 - DNA, 263 bp, Homo sapiens
tagtctaaaagttattctaaatgcatttcatatagccaaaacattaagagacatggaagatataaaaaagatctaaatcaaaactctaaagatgaaaactataatatctaacataaaaaactacatagaattaacagattagacaccgtagaagaaaaaaatccatgaacttggaaaaataccaataaagacgatccaaaaatacaacacaaaaagagaaaagaacacaaaaagaatataaagagcatcagtgaactgtgggg

SEQ ID NO: 411099 - DNA, 170 bp, Homo sapiens
tttccatttttttgtgtgtcctcttcaatttctctcatcaatgttttatagttttcattatagagatctttcacatattttgttctttggttaagttaatcctaggtttctttttagctattgtaagtgagattactttcttgatttctttttcagatagttcgctgttg

SEQ ID NO: 411100 - DNA, 585 bp, Homo sapiens
agcagtcagtgatgtgcctaataagttagatatagtaagctaaacaatgtattttaaatttgatgcccatgcaaacgtagtatagattcatatatttttcacaaaaacgatagtaattgtaccttttttttttttcaatttaagaacagatccataaggttggttttttggagctcatcaagggaaggaaagtttcctttaaaatgggaagcgtactttcccaggaatggacgggctgtgtgtaataaagacaagctcatgaagaaacaatggtccagtccaatgtgtttttgctcagaaaataatagattctgtcatggactaaatcatgccctgtattctccaatgtgactgtacttggagatagggcctttatggagaaaattaaggttaaatggggtactaaagttagggctctaatctgataggaccagtgttcttataaaaagaggaagagacaccagagctttctctctccactcaggcacagaggaagagtcacctgaggatgcaaagagaaggcagagacctacagccagtaagagagacctcatcagaaactgaatttgccagcaccttgacatg

SEQ ID NO: 411101 - DNA, 402 bp, Homo sapiens
cctgcccttctctggcccactgtggtcctctctgtccaaagaaagtagttgtcatctctgaggcctcccagctgtgaccacttgtgattcctgaaccttctaagcacatggtgtctcctaaccccatcagcagcgtgggcatgacgtcacctatccctcccaacagggacccaggaacctttatcaagtagctaggaaagggctacttaaagggactccactccaaatgggaattacaaaattacatcgtaaaaaaggtagagcagatttgattatcttgaaaagaaacaaaaatcatgaaaacaagtatacatttcaggaatcatggttataaaatgatgtgctgattatgagaataatcaaggaataaattgtcaggaattttttccagcaaaaaaaaaa

SEQ ID NO: 411102 - DNA, 502 bp, Homo sapiens
caggcacagtgactcatgcctataatgctagcactttgggaggccaaggcagaaggatcacttgaagccaggagttcaagatcagcccgggcatcatagcaaaactccgtctctacaaaaaattaaaatgaaaattagctgggcatggtggcacatgcctgtagtcccagctacttgggaggctgagtaaggcaaaaggatctcttgagcctgaagttcaaggttgcaatgagctatgactgcaccactgtactccagcctgggcaacagagtgagaccctgcctcaaaaataaaattaaaaacagtcaaaggctgagtgcggtggggctcatgactgtaattccagcacttgggagtccaaggcaggaggactacttgagcccaggagttcgagaccagcgtggacaacacagtgagacctcgtctctacaaaatgtaaaaaaattagccgttcgtggtgggaggattgcttaagccaaggaggtcaaggctatagtgagc

SEQ ID NO: 411103 - DNA, 385 bp, Homo sapiens
tagtaaaacagaagagattagttatgtcacaagagaaaagttagtgtggaggtaattttcaaaagggtagggaggatttgtgctatccagttctcggagacctaactgcagtcatttctaacctaataacacttgttggctggcattctgggtgacatcctgccttcccttttacttttttttttttaattaacagtatctttctgcaattaatgtatagctggaattgaaattgttcaccttctgcatacactttgggtgggatctacgtacgaaatcttgatgttaaccttatctttgacactcatattatgtgttagatggcgtatatatatctagtgtcaagggaaaataaaaatatagtaattaaacttatgatctgtct

SEQ ID NO: 411104 - DNA, 648 bp, Homo sapiens
ttctccgttcaatgtccagaaagtaagttttattaaagtcatgaaatttctcttaactcagtggctttcaaccaaaaagcttaaaatagtgacttacaaaggtcctcataaagcacctcagcagttgacgcatagtccctgtatactcagtaccacccagcagaccagaataaagacgctaaggaatatggtcttggataattaaataactcaggataaaatcatttgttaaaagtatatactgctttgacttggagcagtgaaaaatttctccactgaaaggacatttaatcacagctgatgttctttagagaaggcaacacatgggaataacagcttcctattccttgaaatatatttatataatctcagccccgtgcggtggctcatgcctgtaatcccagcaccttgggaggctgaagcgggcagatcacaaggtcaggagttcaagaccagtctggctcaaatggtgaaacccgtctctactaaaaatacaaaaaaattagccaggcgtagtggcgggcactgtaatcccagctactcaggaggctgagacagaattgcttgaacctggggggtggaggttgcagtgagccgagatggcaccactgcactctagcctgggggacaaagcgagactccgtctca

SEQ ID NO: 411105 - DNA, 396 bp, Homo sapiens
atccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcaggagtttgagaccagcctgaccaacgtggagaaaccccatctctactaaaaatacaaaattagccgggcgtggtggtacatgcctgtaatcccagctacacgggaggctgaggcaggagaatcgcttgaacccaggaggtggaggttgcagtgagctgagatcacaccattgcactccagcctgggcaacaagagtgaaacacagtctca

SEQ ID NO: 411106 - DNA, 416 bp, Homo sapiens
tgacaccccagtttcaggcactaagaaatctctctcggccttgattcctccaacccaggattcaaagcatgcccggaaagactctgatctatgggccgaggcttggaaggggtgtgcgaggcagacggggttattaaagggagagcttggggctgagcaaactggacccctttgggctggaaaggagaaagaacagctcctggaagagaaaaaaaggcacaccgggagctgtgttttgtgaggggaagatcttattattgaggttaatcatggtaatgatctggtatggctgggtcagcccaggagaccgcgctctccaaagttctttctcacagaggtttctctgggggagtcaagggttccccaacttcactatggttggggaaaataaaataaagacctccaatcctctcctc

SEQ ID NO: 411107 - DNA, 455 bp, Homo sapiens
tttttttttgccattatataaataatctgtgattttaacatataaaccaattcacaataaattgatatatttcttttagatatgtacatattggatagctaaggattaagagtttaatggagaatcagtaaatatgatgtaacaacatcttattttaaagtctgctagtaattcagaaagtaaattctgtaagagggagtagaaacaaactaccatatattcaatcttatacccaccagagtaagctaagtaaaaaaatatgttcaggcatatttgtaatttgttatatagcaatagatagctaaattaccttctttatgattctgttaaaagattaacactgaaaaagttaaaaaaaatatgtctagtaaggttgatcctcaggttccactatttgaacacttgggcatccaactctggtctctcacttactgggctatctggcttttacaagg

SEQ ID NO: 411108 - DNA, 345 bp, Homo sapiens
ttttcaccggagaagactgtggcgggggcttttcaggaggaatgaataggaagagtacaggaggctgtatagcagcaggtggctttgtttggttggaaaacactccaagtgaaaaggcattgtgaagaatggaagagctactgagaaaccagcctatggagtttggctgtctctcctagtcacaaataaggagctgttactggtttttgtcaaaagaacaggatgatcacatctgtgccttaggacactttagatggggcagaacaggtacaggggatgtggtgggggaagaaatgactcgatttcaaacaaatcaaataaattactttgatgtttaaaaaaaaa

SEQ ID NO: 411109 - DNA, 404 bp, Homo sapiens
tttttttttttgagacggagtctcgctctgtcgcccaggccggactgcggactgcagtggcgcaatctcggctcactgcaagtccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctttattagcaattttaatctttagagaaatgtctgttcagatcctctgcccgtatttttgtttgtttgtttgttttttaataatttaagggactgggttttgctctgttgcccaggctggagtacagtggcgtgatcatagctcagtgca

SEQ ID NO: 411110 - DNA, 406 bp, Homo sapiens
gaagtgtgtgtgctcaggatacacagacttttctccatgactgagttaatttctcagacatgtgttctgaaaatggtacccgtgcccttgtcccctggcccacagaataatgcagtgaagattcctcaccacagggaattcgctgtttctcacttctcatgttggggtctggtggccttttcatgcttgagtcattttggttattaggggagaactgtttcataagcatgcagaaagaggaggtaaaacagtggttctcaaacttcagggagcataatcacagggtggggagggtggcacctgaagtttacgaggcctcaccttgagtgggcctcagtatctccatttcctccaggggatgctgatggcagtggtccaagaaacacactttcagaaaggctaaagt

SEQ ID NO: 411111 - DNA, 596 bp, Homo sapiens
  misc_feature (223)..(223): n is a, c, g, or t
  misc_feature (501)..(501): n is a, c, g, or t
tctcctgttcctgtgtggtgacctgggattcagtctgtgaggcgggaaatttgctagcaggactctctcttgctctgctgagaggtttcactgtcacctaagctggagtgcagtggcacagtcatggctcactgcagcctcaaccttctgggctcaagcaatccttctgtctcagtccctcaagtgactaggactacagctggatctcctgctacacaacagngaaaatcctaactgatgctgggtcacagaatacatcctggctcatcatttcagacttctactcaagagcttttatgatgctgctctgtcgactcccataagacctcccaaacccaggctccaggctgacatctcacagttcctcaaggtggaccatctccttctgtctgaccaaccctatttatcatcctccttacatgctgtgctcattccttcaatgactcattctacacttttagctactcatggactattgaacacaaatgtacagccacttcncagggttttctaggaaactttgtatcactcactttcactttctgctgggtcagctgcaggtatgaatttgttcatcacagatttagaccaacctg

SEQ ID NO: 411112 - DNA, 457 bp, Homo sapiens
tctcctgttcctgtgtggtgacctgggattcagtctgtgaggcgggaaatttgctagcaggactctctcttgctctgctgagaggtttcactgtcacctaagctggagtgcagtggcacagtcatggctcactgcagcctcaaccttctgggctcaagcaatccttctgtctcagtccctcaagtgactaggactacaggtatgtgtcaccactggctattttttttgtttgttttttgagacgacatcttactatgttgcccaagctcatcttgaactcctgggctcaagtgatcctccctctgcctctgcctcccaaaatgttgcgattacaggtgtgagccaccctgcccggccttgtgtttcatttttaaccctgatataagtaacaacacatctgcttattaatatgttcatgttaacatttactatccagtttgggtggaaggagagtgtt

SEQ ID NO: 411113 - DNA, 445 bp, Homo sapiens
ggtgatgctcatgtgactcatggaggtttgggcaaggtagcagttccctgttttcacagtaggtggaagatcctgactgaacccgagggagggtgggccccaccagcacgtgtccctagcaggggtggggcgggcaggaagcgcagagccccagtggggtgcccggcacctctgcagcaggaagcttgggcagccacggcacgtggatgtgattgttgtgctgagatttttgtttaaattttcttccttttttttgtttctaaccaaaaatacttttctggttcttcttctaccattcccctgcccctcacctcccctttttgtcttcttctgtctcctcatctttttttctgggctcttttgtttttattttcattttttgttacttttgttttccctcttcactcacggaaaccttttttagaccaccaagtttttatttatg

SEQ ID NO: 411114 - DNA, 872 bp, Homo sapiens
taaaaaataaagtgcctttccttcaggcctgcagttagtctgagcagtgtcttcctgtgaaattgaaaaggccaacctgtgagtggacgcagcttgtgtgtgtctggccagtggcctacagctgggggtgtagctcccccctctcctcttggattagggccttgtgcagtgaataatctgacaaccgtacaacgtaaccacactaacccagcttccttctccgaggcatcgtaggtttaagtgttcagatggacatgtgaattgctcccagaaggattcgcatagatccctggtatatacactgggaaatatgcattcagttaaccttaatgagaagggggacagatgatacttacttgttatagttttgagtactaccaaggtcatgtttttagggttttctttggtgcttttctaaatacacaatttaatgttaactttatggatgctgtggtttctcacccagataaaatattatgctgccatacactttgactccaagcatctccttcctccatcctcttccaagtgcaccacatcagtttgttcccaccctgtagtgtaggagctcagcatagtacatgtggctctgcagagccggatatctactttgtatcataacattcaaaccagaccactttgtgaataattgaagcaagaactttgttactggacatctggatttaaggaaaaatacagtgtccttgtagatgaaacttagcctggatttacttttttcattttccagctcccctccattatcagttagcaagcagggagcaagtcatttccagtacattgtgtagaagagttgtatgtgatgggtacagtatggagaacattaaaaaaagtgttggaaaagccaaaaaaaa

SEQ ID NO: 411115 - DNA, 274 bp, Homo sapiens
gcggcccctactactactaaattcgcggccgctcgacctgataaggaattgtacataccgttcttagtgaagcccaaagcaactatgttacatacatggtactcttggttttcacgaagaacggtatgtacaattccttatcaggcatcatctgctatagacttacactaagaggctttgaccaacttttttcgtggatgagaaagcaagtactttcaattgttctttttctatttctgtcttttttttttttttttttttttacaattgaaac

SEQ ID NO: 411116 - DNA, 120 bp, Homo sapiens
ataatgtaaatcttccaactttgttccttttcaaagttctttggactattttaggtcctaggaattttagaattagcatatgaatttctgaaacaaaaaatacgtgggggattttgattg

SEQ ID NO: 411117 - DNA, 360 bp, Homo sapiens
tgcaaatcaaaaaaacaaaaagatgtcattccttatgagtttgacaattcagaagttgatttttacaaagtattcttacccccattaagagggtaagacatactgttttgtaccccttggccgggcgcggtggctcatgcctgtaatcccagcactttgggaggccgaggcgggtgacttgcttgaggtcaggagttcgagaccagcctggtcaagatcgtgaaaccccatctctgctaaaaatacaaaaattagccaggcacagtggcgggcgcctgtaatcccagctactcgagaggctgaggcaggagaatcgcttgaacccaggaggcagaggttgcagtgcgctgagatctcgcc

SEQ ID NO: 411118 - DNA, 481 bp, Homo sapiens
gttttttttaatgttatcaccaaaaatgcatgaggtgatgaatatgctaattaccttgatttgttcattatacaacatatacatgtatcagaacatgaaattgtaccctataaatatgtataattacaatgtgtcaactaaaaatgaaaaaataattgaactatcaccttattcaccttcaccacacattggtcatatttctgaccaatctagattgttatggtcataggtgatgatgcctgtgtgaccctgcaaaattaacactagatattctcatgaaaaacaaagcgtttgcttcatatgaccttattctatttgcagaagtaatattctcttctactcccacttaggaaatatcaagtactggaaaaggcaaaatatctcttctttacaaaagttaaccaagaagagaattgcatgctactgcatggaacagatccttcctcccttctgagaccgacaagaaaatcgcataaaggag

SEQ ID NO: 411119 - DNA, 492 bp, Homo sapiens
agaggcttccctttggtcctgctataataatgtcccttactccacagttcacgaataatgtgagtgtcctgccagctgccatgcatatccatttcagttacactttcaggaagaggtaataactacaaactgattagctccaccttgggatggacatgagccaaagctctaggtagcatctgaccttcagaaactctcaatgcaggctggatgtcatggctcatgcctgtagtcctactactttgggaggccaaggtgggaggaccccttgagagcaggagttccctttgcaacatatggaaactccatctctacaaaaaatttaaaaaattagctggcatgttggtgcatgcctatagtcccaaatacttgggaagctgaggcaggaggattgcttgagcccaggagttcaaggctgcagtgggctatgattgtgccactgtactccagcttgggtaacagagggagactgtgtctcagaagaaaaaaaaa

SEQ ID NO: 411120 - DNA, 522 bp, Homo sapiens
tgaaccctgtaattactctggcttaatgcctaaagagtcccaggctgcagcacaggaaggaggaaccccaacagagcctggcaatctctgaggttgaggagacacagttaaatattggaggaagccaaggaggctaaaactcacaagcagagtaccggaaaggaagaaacccgcaaacagagatacactcagagatcactggagtcttcagctgagtgctgtgtgtgaggaaatatgtcaaagctgggaaaagaaccaccacagaggtggaggcagaaaaattattgtaacacatatggggctggaatagttcaagaaatcttgtaatacatggagcatcaggttgaaaattcagaaaggtactgccttagcaatgatgtcaaattaaccctagagtaaaggtttctctggtctctctgataaagcttaaaagtaagtttagaaagaatcaaaaaaatcaaactgttcccaaatttaacttcatcccaatcctcaaacgtatttaaaagcacatcaaaaaaa

SEQ ID NO: 411121 - DNA, 410 bp, Homo sapiens
ggggatggtgacacatacctaggcacagctaacgggcatgataatgactcatatgtggacccagccaataggagaaattttgactcataactaggtttagggacatgagtgatgtaaagggtctccttctggtaaaaaggtcacagaagattataacacacacatattttataacacccttgggttgtatagagagtgtcagaacagggcctagcacatggagaaaattgtgagtctcatatgcacacccacctgacagtaaggactttcaccatcacagatggatgaaggcaactgtcctacatgaaaacagaacatgtgtggtattgtaaatctaatccctaaaattttatttcatcgtgatagtcatgtgatataaatttcatgtgatataaatctttgccaagcac

SEQ ID NO: 411122 - DNA, 411 bp, Homo sapiens
tttcttttccatctacttcttacttatccctccgcaacaaaactttaattctaattattgcttagaaactgttttctaaaaacaatgactttcctctagtcaagttcagtggtctcatctgaaacttcataaggaaattctctctcctatagggagaattgctaaccactccacgcaccgttttaatcattttaccttggcttctatgactccctctgtctaactcaaaacccagtgaagtcttagtctggattgctgatttctccttcttccccatctattatggccaccctaatgtttaagtctggactgcactgctctttctctcaaatgcatttgttactgttgttgttcacttggttttaaacaacttccttcctgtaactgactccaaaatacactgttccagtc

SEQ ID NO: 411123 - DNA, 851 bp, Homo sapiens
tgctagtttttaataacattggaaaatagggtccacaagcaagaaagctaagagtcctgtaaagtctccatagttttgccttttccagaatattgtgtagttgaaatcatatagtatgcagcctgtttggattagcttcttccacttagcaatatgcatttaaggttcttccatgtctttttaaggcttgataacttatttcctttatttttggctgagcaacatttccactgtatggatgtgctgcagtttttaaagttcattcacttactgaaggacgtcttggttgcttccaagttttgccaattatgaataaagctgctataaacatttgtgtgcaggtttttgtgtggatgtgagtttttacttcctttgtgtaaatatcaaggagcaggatcactggattgtatggtaagagtatacttagtttgataagaaaccaacattctgtcttccacagtggctgtacgatttttccttcttaccagcagtgaatgagagttcttgtttctccacatccttgctgacatttggtgttgtcagttggattttggccattctaataagtgtgtagtgttatctcatgttaatttgcaaggccctaatgacatatgatgttgatcatctttttgtctgcttatttatcatctatatctctttagtgatgtgtccagatcttttgtccattttttaatcaggctgtttttctttgagtattgtcgaattttaagtgggttttttttttcgggtataattttggctactagttcataatcaggtgggtctttggcaaatattttctcccagtccgtgacttgtttttcattcttttaacactgtttttggcagag

SEQ ID NO: 411124 - DNA, 305 bp, Homo sapiens
gtcatgaatgaaaatgtcaatgcattttcataacagaatataccttttggtattggcaaagaaattaattcttcattgcacccgctgcataaagaagcgactttcatcctgtgtaatgtgtgagcctccatgttgcattattaatgtgcactatttacaggcgtacaatgcagacagcaatttcccataaaattgctgagtgtttcgtcttgttcatttgaaatgatttgaaaatggtcattcaaccagattgttatggtaatgctacaaatttaagtagtattttagaaacaataatgtaaaat

SEQ ID NO: 411125 - DNA, 433 bp, Homo sapiens
agtgcgcgcgcgagggcgccttgcccttctcccaatggcgggccgcgggccccttcccggcagcctccctcgggcagggagcgcgtcatttccggagggggaggcccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggcggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcg

SEQ ID NO: 411126 - DNA, 2724 bp, Homo sapiens
gcccagcgggggcgggactggaacggagccgtgcggccccgcgcgctcgcagtctgtctcccgccgtccccacgcacgcgtcccggctcacgcgtccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcagaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtgggctgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagacagcaggcctcgtgccatggaaggaa

SEQ ID NO: 411127 - DNA, 1324 bp, Homo sapiens
gggaggactgcaaggagggaggcgtgtgtgaacttgggttgagcacccccccagggcagccccaaattcctgaagctggcactggagaggcgcagagcaggcccagccctccagctgcccatgctcagcccctcatgccccatctctggccccacagctgcccaggctcagcccctcatgccctgtctctgcccccacccccccggcagctggcggagatccacggtgtgccccgtgggctgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagacagcaggcctcgtgccatggaaggaa

SEQ ID NO: 411128 - DNA, 2876 bp, Homo sapiens
gcccagcgggggcgggactggaacggagccgtgcggccccgcgcgctcgcagtctgtctcccgccgtccccacgcacgcgtcccggctcacgcgtccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaactgctccgtcctctagtcaaaaaagtaccaaccagggacctgagtggaaaaccacagggcgtggcgtctgcgtgaggctggaccctgcagtgaccgtcctgagctgcgctgagtgatgctttgctccctggcactcccgaggagctagtccaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcagaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtgggctgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagacagcaggcctcgtgccatggaaggaa

SEQ ID NO: 411129 - DNA, 838 bp, Homo sapiens
cgttcttaccccaggggttactcaggcgttcttaccctgagtgttgccatggcgagggccgtggctggagccctgtcctgatcttggctgcctgggtggcactctagtgcccgtcttcacgggggcctggtatccgtctttgtggggtcccagcggtccagcatctgacctggcaggggccccgtgtcctgccgtccaaccttgtggggggcctggtggtccagcgtctgtcctcacgggggcctggtgacctggcatccatccttgtggggtcctggtggcccagtgtctgtcctcgcgcaagcctcaccccaaccccacccgtcgccctcagctcagccttcttgttccccaggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctggtaagagaaggcggctgtaagtcagggttggcctttgtggggccgggaccccagggcagccttcccaggagaggcgcaggacagaggcccacgtggcagcagcagtggcctcagccatcccagggccgtccacacagcctgtcccaggccagacactgaaatgggccctgtccacgtcacctcgctgcgtggccgctgcatctgtggtccccttgtgccatggaggaggctggggcagagcggtgccgtgtgcacctgcctagccaagggagaagtgaccctccctgcctgcccacgcctgtcccctttgtc

SEQ ID NO: 411130 - DNA, 2655 bp, Homo sapiens
gcccagcgggggcgggactggaacggagccgtgcggccccgcgcgctcgcagtctgtctcccgccgtccccacgcacgcgtcccggctcacgcgtccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcagaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacaggctggcggagatccacggtgtgccccgtgggctgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagacagcaggcctcgtgccatggaaggaa

SEQ ID NO: 411131 - DNA, 2544 bp, Homo sapiens
gcccagcgggggcgggactggaacggagccgtgcggccccgcgcgctcgcagtctgtctcccgccgtccccacgcacgcgtcccggctcacgcgtccgcccgcccgcccccgcttgtgccgcccctaccagagacccccaggagcaggatgtccttccagggcaagaaaagcatcccccggatcacgagtgaccgccttctgatcagaggtgggaggatcgtgaatgacgaccagtccttttacgctgatgtgcacgtggaagatggcttgataaaacaaatcggagaaaacctcatcgtccctgggggcatcaagaccattgacgcccacggcctgatggtccttcctggtggcgttgacgtccacacaaggctgcagatgcctgtcctgggcatgacaccggctgacgacttctgtcagggcaccaaggcagcgctagcaggaggaaccaccatgatcttggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgtgaactccttcctggtcttcatggcatacaaggaccggtgccagtgcagcgacagccagatgtacgagatcttcagcatcatccgggacctgggggccttggcccaggtgcacgctgagaacggggacatcgtggaggaggagcagaagcggttgctggagctcggcatcactggccccgagggccacgtgctcagccaccccgaggaggtggaggctgaggcggtgtaccgagctgtcaccatcgccaagcaggcaaactgcccgctgtacgtcaccaaggtgatgagcaagggggcggccgacgccatcgctcaggccaagcgcagaggggtggtcgtgtttggggagcccatcaccgccagcctgggcaccgacggttcacactactggagcaagaactgggccaaggccgcagccttcgtcacatcaccccctgtcaacccagaccccaccacggcagaccacctcacctgcttgctgtccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggcctctgggaagatggacgagaatgagttcgtcgcggtgaccagtacaaatgctgccaaaatcttcaatttttacccaaggaaggggcgagtggctgtgggctctgacgctgacctggtcatatggaaccccaaggccaccaagatcatctctgccaagacccacaatctgctggcggagatccacggtgtgccccgtgggctgtatgacgggcccgtccacgaggtgatggtgcctgccaagccagggagtggcgctccggcccgcgcgtcctgcccaggcaagatctccgtccctcctgtgcgcaacctacatcagtcggggttcagcctatctgggtctcaggctgatgaccacatcgcccgacgcacagcacagaagatcatggcaccacctggcggccgctccaacatcacctctctctcctagacgcccaggaccggccctgtgagccgtgctggccccacccgaggccgcgggggccccagggcactcgcccccctccttagcattttcttttgtagaagtttctcgaaggtgcttggcggtcttgccttccccctccccacaggctctccttgtggggtcccaggtcctgctgccaagagcccctcaagagaagggctgaacctggggagatgtcactgccagggtgaggtggagccacatggcagggacaatgccggcagcctgagcccaggcaccccagtgcccgctgggcccagcctggggacagggaacctgccgggctcacagtgtgggagcagctggacaccaggcttcttggtgaaccggcgaggggccgagtcccgcctggtgggcatttgccgccgcctccccaccaccagtcactgcctcgcagagccctacactcccgcagccgctcctcagaggcctgtgcccatcgcaggcctgggaggaaagtgggcgcagagccctcctgctcacacagctgctgagacttcagggacccatcagaacttggtgcagcacagccccgcccgtggagggtcccttttacgcaccccaaggcccacacctaagcttccatgtagccctcatccagggaagttttgcgatcctttaggaagacactgtcctcttattacagattgtgtatttccgtaggcttcttagtagcagctttgtacactgaggacactgtagccaggaacctgtgcatgccacccaccgcctggacaggcagtcatcctgcctctgatgtgaatcaggcccattaaagacgtctgggtttgaagacagcaggcctcgtgccatggaaggaa

SEQ ID NO: 411132 - DNA, 477 bp, Homo sapiens
gagggaatggttaagggaggggagaatggtagctcccttgcaattaaagaaggaagaatcatgaacaaagttattaggactccaggtacacttgtctcataaactgaagtcatccgtggtttgccgtgaggtctcctgagtttattggagcctttattgcgtctatgacagagagagagaaagtgctcacatttcacctgcatgggaattataaatgtcaacagcttatatgtcctgaaccggagcccatgtcacccagaactgccactgagagaggttttccagagggcagtgttctgacttgagctgctatccagtccttcacagcacagccttgaatgggtacctttctacaaacaaatgagaatatgcacttgtgaaaacagaaggtgaaaatagccaagggaagaaaagaaaaatcattcctaatttcaccacttagaccttaataaatggcctttcagacttttaaaaatg

SEQ ID NO: 411133 - DNA, 4803 bp, Homo sapiens
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacgggagtgagagtctggtgagcccactcttcacccgtcaggccctggccgcaatggacaagcctcctgctcactccaccccacccacatctgccctgtccttggcagctgaaggacaccttgacttccagcttttacgagtgagccaaaaacagaaggacaagtacaactgtgctggcctgctgtacaagcttcaaaaagtgtcccagagcccgcacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaaagca

SEQ ID NO: 411134 - DNA, 3556 bp, Homo sapiens
ccacctccctgtgtgctggggcttctactaaaaacacagacaagatcaggcaaccacagtcaatctaagggaaagaggaaagtgtaaccaaagcacaaatacataaaatattgcaaaaaatgctatttaaagaaaaaaaagagaagagaggctctgaggttgtactaacagagaatggccttggctaatccaggaagacttcctgaaagaggttgttttttccccaggtctgcttttgacatctctcttttcacagtgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacgggagtgagagtctggtgagcccactcttcacccgtcaggccctggccgcaatggacaagcctcctgctcactccaccccacccacatctgccctgtccttggcagctgaaggacaccttgacttccagcttttacgagtgagccaaaaacagaaggacaagtacaactgtgctggcctgctgtacaagcttcaaaaagtgtcccagagcccgcacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaaagca

SEQ ID NO: 411135 - DNA, 4832 bp, Homo sapiens
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgtgtctgcttttgacatctctcttttcacagtgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacgggagtgagagtctggtgagcccactcttcacccgtcaggccctggccgcaatggacaagcctcctgctcactccaccccacccacatctgccctgtccttggcagctgaaggacaccttgacttccagcttttacgagtgagccaaaaacagaaggacaagtacaactgtgctggcctgctgtacaagcttcaaaaagtgtcccagagcccgcacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaaagca

SEQ ID NO: 411136 - DNA, 1524 bp, Homo sapiens
gtccgggcggccaactccaaggtcgccttctcggcggtgcggagcaccaaccacgagccatccgagatgagcaacaagacgcgcatcatttacttcgatcagatcctggtgaatgtgggtaattttttcacattggagtctgtctttgtagcaccaagaaaaggaatttacagtttcagttttcacgtgattaaagtctaccagagccaaactatccaggttaacttgatgttaaatggaaaaccagtaatatctgcctttgcgggggacaaagatgttactcgtgaagctgccacgaatggtgtcctgctctacctagataaagaggataaggtttacctaaaactggagaaaggtaatttggttggaggctggcagtattccacgttttctggctttctggtgttccccctataggattcaatttctccatgatgttcatccaggtgagggatgacccactcctgagttattggaagatcattttttcatcattggattgatgtcttttattggtttctcatgggtggatatggattctaaggattctagcctgtctgaaccaatacaaaatttcacagattatttgtgtgtgtctgtttcagtatatttggattgggactctaagcagataatacctatgcttaaatgtaacagtcaaaagctgtctgcaagacttattctgaatttcatttcctgggattactgaattagttacagatgtggaattttatttgtttagttttaaaagactggcaaccaggtctaaggattagaaaactctaaagttctgacttcaatcaacggttagtgtgatactgccaaagaactgtatactgtgttaatatattgattatatttgtttttattcctttggaattagtttgtttggttcttgtaaaaaacttggattttttttttcagtaactggtattatgttttctcttaaaataaggtaatgaatggcttgcccacaaatttaccttgactacgatatcatcgacatgacttctctcaaaaaaaaagaatgcttcatagttgtattttaattgtatatgtgaaagagtcatattttccaagttatattttctaagaagaagaatagatcataaatctgacaaggaaaaagttgcttacccaaaatctaagtgctcaatccctgagcctcagcaaaacagctccccctccgagggaaatcttatactttattgctcaactttaattaaaatgattgataataaccactttattaaaaacctaaggttttttttttttccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagatt

SEQ ID NO: 411137 - DNA, 283 bp, Homo sapiens
ccgtagacatgaccactttattaactggtggtgggatgctgttgtttctaattatacctatttttcaaggcttctgttgtatttgaagtatcatctggttttgccttaactctttaaattgtatatatttatctgtttagctaatattaaattcaaatatcccatatctaaatttagtgcaatatcttgtcttttgtataggtcatatgaattcataaaattatttatgtctgttatagaataaagattaatatatgttagttgaattgtttttttctttccg

SEQ ID NO: 411138 - DNA, 690 bp, Homo sapiens
tctcctactagaggaactttaggaggcgtgacaaggaccacaaatgaagctattctgttgtgtgaaggagcgggatatgacataattcttattgaaaccgttggtgtgggtcagtcggagtttgctgttgctgacatggttgacatgtttgttttactactgccaccagcaggaggagatgagctgcagggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatca

SEQ ID NO: 411139 - DNA, 574 bp, Homo sapiens
tctcctactagaggaactttaggaggcgtgacaaggaccacaaatgaagctattctgttgtgtgaaggagcggggtatcaaaaggggtataatcgagatggcagatctggtagctgtaactaaatctgatggagacttgattgtgccagctcgaaggatacaagcggaatatgtgagtgcactgaaattactccgcaaacgttcacaagtctggaaaccaaaggtaattcgtatttctgcccgaagtggagaggggatctctgaaatgtgggataaaatgaaagatttccaggacctaatgcttgccagtggggagctgactgccaaacgacggaagcaacagaaagtttggatgtggaatctcattcaggaaagtgtgttagagcatttcaggacccaccccacagtccgggaacagattccacttctggaacaaaaggttctcattggggccctgtccccaggactagcagcagacttcttgttaaaagcttttaaaagcagagactaataaaattcatcctgtataataattttacatatcatttcataaagtattttaatagaaaaatca

SEQ ID NO: 411140 - DNA, 574 bp, Homo sapiens
cctgtgcagctgctgcgctcagccttgaacaccctcccgaccttggggctctgctgccccacgcggagcccccatttcaacagatgcagacaccccaaagccccttcccaacagcccgaagagaagccctcctctgaagagacagcagagaagcagagccccctgggacgccccccaagacctccacgtctccccagcacccggcgggggggtggtgcatgcacttcccgtggctgcgggaacaaactgccacacacagggaggctgaacacagcagaagtctattccacacagtcctagaagccagaggcagtgacatcaaggtgctggacggccgccctcccatcggaggctctgggaagaatctgttccttcctcttccagcttccacgactcagggcagcacccctgtaacctctgcctccatggtgatatcgcttcccctcttctgtgtcaaatgtccccctgcgtccctcttcaccagaataatcccctcatctcaagtgccttaatttaatcacacctgcaaagtgtttgccgcgtaaagtaacaattacagtttccagagattaaa

SEQ ID NO: 411141 - DNA, 426 bp, Homo sapiens
cccattctacagagatgtgaaaactggaagagaaacaggaagtacctccaggattcacctaaatagatgctgcggtttctatcaaaccacaggccaccccagcatctcagtggcttctataggttgtcctgaaagagccatgaggccagggcccttgatggattcccagataccagctgctcctccagacaccaattccaccctccacctttctgtgtccgtcccagaccaaggcagcccaggactggtatccttctaagaagaggaaggcacatcagaggagaggccatgtgaggacaccatgggaaggcggccacctgcaagccaaggagaggggcctcaggagaaaccagccctgctgacaccctgagctccttgcaattccagcctcctagactgtgagaaaatacacttgtgttatttaag

SEQ ID NO: 411142 - DNA, 504 bp, Homo sapiens
cccattctacagagatgtgaaaactggaagagaaacaggaagtacctccaggattcacctaaatagatgctgcggtttctatcaaaccacaggccaccccagcatctcagtggcttctataggttgtcctgaaagagccatgaggccagggcccttgatggattcccagataccagctgctcctccagacaccaattccaccctccacctttctgtgtccgtcccagaccaaggcagcccaggactggtatccttctaagaagaggaaggcacatcaggaggctctgggaagaatctgttccttcctcttccagcttccacgactcagggcagcacccctgtaacctctgcctccatggtgatatcgcttcccctcttctgtgtcaaatgtccccctgcgtccctcttcaccagaataatcccctcatctcaagtgccttaatttaatcacacctgcaaagtgtttgccgcgtaaagtaacaattacagtttccagagattaaa

SEQ ID NO: 411143 - DNA, 367 bp, Homo sapiens
caggtagacctaacatatactcattgtcattctaacactgttagaaacttgtcttcatgttgagcacaagcccaaattgtgttttatgtcatatgtcacaaagctggcaggtgtgaagttgctagatagaaaacatccagtagtgttagaggacacctaagacatcagttatgtccaaacattttggtttgatttggttagttttttatggtatgtcattaaccaaggaatttaagttatagcttgtttttcttgggttaatattttgtcaataggttgcctgagtttctaaattacatagacatctcttaaaatattcagagtaatgtataaaaagatgcatattcaaaaaaaaaaaagtaaaatg

SEQ ID NO: 411144 - DNA, 337 bp, Homo sapiens
catctacactgctgtcagggggctaagaggatttgggtcacagctgcccaggcaatcagacaggccagggactcagaactttcctttttgacagccagttggaaatcccatggcctctgtgtgtattgctgtctctgggatgtaatcttatattgtctaggcctctgttttgccaactgtaagaccacgaagtggacaaggaccactgtgctagggacctttcaacccaaacatcctgcagcccagcctggctcattagcagttcctcctgggccctgggtggtggcaactctgctggctctggtcactccctgggccgcagtggtcctgcctgcat

SEQ ID NO: 411145 - DNA, 552 bp, Homo sapiens
aattagtgctctgtggctagctagaggtttgtaagattgaccaatcagcgctctgtaaaatggaccaatcaatcagcaggacgtgggcagggacaaataagggaataaaagttggccaccccagccagccgcagcaatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgatggatctccctttctgtataaacagtgccagttctgggctttgtaacctttgctctttatagtctttcattcctggggaagtgatggggcatgggcccagagctggggtgtatgtggtatggacacctgtttgtggggctttccagcaaaggattatttaaatagacctctaacata

SEQ ID NO: 411146 - DNA, 1584 bp, Homo sapiens
ctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgcctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411147 - DNA, 5177 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctgctcatttcttgctctgaaaattgtagtcagcaaaagagatcatggaagaaatcactgtaatggtagtaatagtaacacatgccatttgtattgtgccttaggtttaccaggtgtttccaaatacattagcatatttg

SEQ ID NO: 411148 - DNA, 1437 bp, Homo sapiens
actggccggaccgacactgaacgtagactgttcatagcttgttgcctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411149 - DNA, 4955 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgatggatctccctttctgtataaacagtgccagttctgggctttgtaacctttgctctttatagtctttcattcctggggaagtgatggggcatgggcccagagctggggtgtatgtggtatggacacctgtttgtggggctttccagcaaaggattatttaaatagacctctaacata

SEQ ID NO: 411150 - DNA, 1761 bp, Homo sapiens
ctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgcctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactgatggatctccctttctgtataaacagtgccagttctgggctttgtaacctttgctctttatagtctttcattcctggggaagtgatggggcatgggcccagagctggggtgtatgtggtatggacacctgtttgtggggctttccagcaaaggattatttaaatagacctctaacata

SEQ ID NO: 411151 - DNA, 4629 bp, Homo sapiens
gctccgcgtgtgtgccccaactgtcctggaagcttcaattggaaaactccaaactttaagttttgcttatagcttcagctcaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411152 - DNA, 1586 bp, Homo sapiens
  misc_feature (1538)..(1538): n is a, c, g, or t
ctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgcctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagagaccagactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttctaccttgttgcctggtaactttttctgaggactgagtttctgcagcgatgtggtgcactcttcctgtgatgaggaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctatncacttcaacaattgccgatagcgatgaagggggggttatgtttttggg

SEQ ID NO: 411153 - DNA, 2116 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggtgaggatgatgtggtgggcagggcgtcaagggagaaacctcagcaagcatcaggtaggtatgacacgcctgctcccagttcattgcatctatttttagtctctgctaacctcctgagaagtccacattctctttctagatttggtctgccgctgctcctggcctaatttgagcaactctcctttgctactgaatataagatgtgtggagggacccacataccagaa

SEQ ID NO: 411154 - DNA, 4778 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgtgaaaatgctccgagcagatgccaacaagaatgccaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411155 - DNA, 4740 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaaggcttctcggaggatgctggatgatgaaatgacagtcagcctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411156 - DNA, 4701 bp, Homo sapiens
gaatcctcagaatgtgaggtttctctcaaaggcatcttgcatcagcctgtggatgtatgcctaccaccgggctccttcaccagcaaagtggaaaaagaagcgtttcacaacaaattcttctttttgggttggggaaacgcagtggattatagctctgttttcttctttccaaaactgtgcacccctggatgaaacctccatcaagggagacctacaagttgcctggggttcagtgctctagaaagttccaaggtttgtggcttgaattattctaaagaagctgaaataattgaagagaagcagaggccagctgtttttgaggatcctgctccacagagaatgctctgcacccgttgatactccagttccaacaccatcttctgagatgatcctgattcccagaatgctcttggtgctgttcctgctgctgcctatcttgagttctgcaaaagctcaggttaatccagctatatgccgctatcctctgggcatgtcaggaggccagattccagatgaggacatcacagcttccagtcagtggtcagagtccacagctgccaaatatggaaggctggactcagaagaaggggatggagcctggtgccctgagattccagtggaacctgatgacctgaaggagtttctgcagattgacttgcacaccctccattttatcactctggtggggacccaggggcgccatgcaggaggtcatggcatcgagtttgcccccatgtacaagatcaattacagtcgggatggcactcgctggatctcttggcggaaccgtcatgggaaacaggtgctggatggaaatagtaacccctatgacattttcctaaaggacttggagccgcccattgtagccagatttgtccggttcattccagtcaccgaccactccatgaatgtgtgtatgagagtggagctttacggctgtgtctggctagatggcttggtgtcttacaatgctccagctgggcagcagtttgtactccctggaggttccatcatttatctgaatgattctgtctatgatggagctgttggatacagcatgacagaagggctaggccaattgaccgatggtgtgtctggcctggacgatttcacccagacccatgaataccacgtgtggcccggctatgactatgtgggctggcggaacgagagtgccaccaatggctacattgagatcatgtttgaatttgaccgcatcaggaatttcactaccatgaaggtccactgcaacaacatgtttgctaaaggtgtgaagatctttaaggaggtacagtgctacttccgctctgaagccagtgagtgggaacctaatgccatttccttcccccttgtcctggatgacgtcaaccccagtgctcggtttgtcacggtgcctctccaccaccgaatggccagtgccatcaagtgtcaataccattttgcagatacctggatgatgttcagtgagatcaccttccaatcagatgctgcaatgtacaacaactctgaagccctgcccacctctcctatggcacccacaacctatgatccaatgcttaaagttgatgacagcaacactcggatcctgattggctgcttggtggccatcatctttatcctcctggccatcattgtcatcatcctctggaggcagttctggcagaaaatgctggagaagctttccctgccaagtgattctagcatgttcaacaataaccgctcctcatcacctagtgaacaagggtccaactcgacttacgatcgcatctttccccttcgccctgactaccaggagccatccaggctgatacgaaaactcccagaatttgctccaggggaggaggagtcaggctgcagcggtgttgtgaagccagtccagcccagtggccctgagggggtgccccactatgcagaggctgacatagtgaacctccaaggagtgacaggaggcaacacatactcagtgcctgccgtcaccatggacctgctctcaggaaaagatgtggctgtggaggagttccccaggaaactcctaactttcaaagagaagctgggagaaggacagtttggggaggttcatctctgtgaagtggagggaatggaaaaattcaaagacaaagattttgccctagatgtcagtgccaaccagcctgtcctggtggctgaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcagttacaccaatctgaagtttatggctacccaaattgcctctggcatgaagtacctttcctctcttaattttgttcaccgagatctggccacacgaaactgtttagtgggtaagaactacacaatcaagatagctgactttggaatgagcaggaacctgtacagtggtgactattaccggatccagggccgggcagtgctccctatccgctggatgtcttgggagagtatcttgctgggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcagacttacctccctcaaccagccatttgtcctgactctgtgtataagctgatgctcagctgctggagaagagatacgaagaaccgtccctcattccaagaaatccaccttctgctccttcaacaaggcgacgagtgatgctgtcagtgcctggccatgttcctacggctcaggtcctccctacaagacctaccactcacccatgcctatgccactccatctggacatttaatgaaactgagagacagaggcttgtttgctttgccctcttttcctggtcacccccactccctacccctgactcatatatacttttttttttttacattaaagaactaaaaaaggaaaaaaaaaagcctagggcagatacaatctagtaaaagaaaatctttgatataccaaagtgttggataacaaaggctagaaaattcagataatttataaaggttaactatacttgtgcttataaatgtgcagattctacaatatttttccatgtcattctaaaagaatcttcagaaagaaaaacttgaagaatactaatgtcttgggaaacatgagattaagtttagggaaaacacttgatagatgtggagaatctgaggactcagaattcagcaactaatcacaggtggttttctaatttggcctctggacatgtctcactgtttgtatttctctctcctgtcaaagtgaatgatatattcttgaaaacccccaatttcttgaaatgggtgttctgttcattcatgggcaggggtcaggattgaagttcatatatgaaacaactggggatgtagataggaaagaatgtctgctgcaagagtgtatgaagggggattgtcatttacaaaaaaaaaagtacctcatggatggaaggattcatgaatagataatggacataggaaaggaggtcaatggaggacacataacagacatgctatccaccatttatttgtgattttgtaagagggttctcttctttgtcttgttcagatattttcatgtgtgtgttttagtgagaatctgagtttttaatcagtaaagtctgatgttttgataacttgatgttttgatggtagactcttgagttcatcttgtccaaatcttctagcattttcaaggatgaagcctctgtgggatctttgggcttggggctgaatttctcaggcataaatacctaatggccttgtctaagagggaatagatctgttctgagtgtccccaaaaaagttgtcctaggaactgatgtggagaagttacagggagactgatttccattccttattggggaaaacgaagcactcagaacatacaaggataaatgggctgccaccagaggtgaggagtctcttgtcactggagaggttaagatagaggctcaagaacaatgcaaggaaaatggaggttttcaaacacaaagtggatggtggtatgagacaatgtttaatgtccttctaactccgagagtccttgattctggagaggcacaggatgaacatctgttgctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacatctgggcccccttctgcaggctttggaagatgatgtgtcttgtcaaggggtaaagggcaaatggatttaatttctgcttaaaactatcatagacgttccaaatagaatatgtaaaatttctctgtattagaaaaagaaacgtgataccaattgtatattttcttttctttatttattctctgtaagtctgtcagatgataaattgtaaataacaatgattaaagagtcatgctactga

SEQ ID NO: 411157 - DNA, 653 bp, Homo sapiens
gggaatggaaaaattcaaagacaaagattttgccctagatgtcagtgccaaccagcctgtcctggtggctgtgaaaatgctccgagcagatgccaacaagaatgccaggtctgtggtctacattttgaattttcctttatgtatttcatctttaggaccaggaatactcctggatacttctgagcaattttttcttttgagatgggaaggtcagtgagctgcctcccatttccactgttatcctttttcttattccgatggggtcggcagtcctcatctttttctccacctctctcaaacacaaaggtacattttccattgtacttgccacatatttacttcctaaccccctgtgcacaagcactgtacttgttcccaacatatacaactgtctaaatgtgtacttctttggtctttatacacagacatactcctgcatgtcattacctcctcttgacaaagtcttcagaatcacacatgactttcttgctaagcctcttccagtctccttttttcacatttctatttattttctcatcccttttttctcttttatgctccttttcttctatctccagcaaccctcaaaatgagaagctacctctatttggaaaattatctatgaacctcaaagcaaaaggatccacagttct

SEQ ID NO: 411158 - DNA, 795 bp, Homo sapiens
ttttttccagctgtgggcagacagatgtggcttcagaaaaatagagatatgcaaggttgttggccttgaatactgacaatgggaccagaaaccaaggaatgcggatggcctctagaagctaaaaaaggcaaggaaatggattctctcctgaaacttccaacaagaaacacagccatgggaacacccataagacctgtgttgatttctaacctatggaattgtaaggaacattgtgctctctccagggttcatacgcaggtggtattaagcagcctgtggtatccagaaatgccattctcaagattgcaccttttaacctcaatatagtacctaaaatatagaagtctagtaaataactgaaatattttaatcaacagagtaaacacgtttattctaactttgacatacagtagatacttaaatatatgctgaacgcatattgaactgaacactggctcattgacaggattcggactttaagcatggtatttatgagtctggaaaaagatgtcaacttacatgctccaaatagataaatgccactaatgatcactcacaatttaattacatatgataaattttgcaaacacatatctgatctttaaatgaataaacaaacgacatgctggagtatctggaactgttttctcttatacccagtaagtgcactaccagtcagcaggagagcaagtggatagcacctggagcagtcagtgtggggccacatgtggctgcagagcactgggaacgcgccttgtccaaagtgtgtgaacatctgcagcgcatggtgagact

SEQ ID NO: 411159 - DNA, 439 bp, Homo sapiens
ttttttccagctgtgggcagacagatgtggcttcagaaaaatagagatatgcaaggttgttggccttgaatactgacaatgggaccagaaaccaaggaatgcggatggcctctagaagctaaaaaaggcaaggaaatggattctctcctgaaacttccaacaagaaacacagccatgggaacacccataagacctgtgttgatttctaacctatggaattgtaaggtaataaatttgggttcttttaagctagtaattttgtggtaatttgttatagcagcaacagaaaactacacaaatagtaatttaaagtttttcattttttattactgttaatataaattaaattttatttttgtatatgattacatctagtgagtttggtaacctgttatttctaacaatttagctatagattcttttggttcttctaaatatg

SEQ ID NO: 411160 - DNA, 407 bp, Homo sapiens
ctatttatgaattctcgcattggtttcgaaaactcaacacagttaaatgaacaggaattgaaggtgcatgatagatgcgtccctcatagcatttaaatctcttccacttgattaaaaattcctagttcctcttcactgaattgtttagagtttttgagcagcctctgccctgattaaaacaaattagcatcaaagatcccctgttgaatgagaaatcattaattgagaaacatgcaatgctccttaattacttttagaacagtgagagaacaaataatctcaggttccagagggccctgcctgctctgcaccgtgaactcatttcgtgtagctgctggaataaaactcaagtagcaaacactattggggaatatcaatgcaagcttcagtaaacacactgtagattg

SEQ ID NO: 411161 - DNA, 744 bp, Homo sapiens
gaaattcagtgcatcttgaattagaattaatacatgaatttaatgaatgtcctcatctatcttaactctgcaaactggaatgtggcgctcacgtaaaactttttctctgttttctctcttaggattttcttatgtcacagccattactcatgttttcgttcttttggctgggattatcatgggactcctctggcagaagttggttctgggaagatggctctgttccctctccatccttgtacgtctctaactattgaggatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagccaaaccagcttttaaaatgactgtgtatttacattatcagacaaatgaacttgtttaacagaacattctccagttccttgtctgacgtcttctgatttgatgttattattcggtcttaaaattatacctggggacaaaggggaatagccatactatggccctatgattgtctcagaatcatttcactgaatttctttgctttctcaaataaagactcctttctttcattattattatactgtcacgtgtgca

SEQ ID NO: 411162 - DNA, 1133 bp, Homo sapiens
gcagattagctagccttagatagatgtaaagaagacaacctgactcttttctgaaacattcagagcatcctctaccccgaggatcatgggaattccctcatgttcctcctgctctgcctcaagcaccccttctttgctgcacagcaagaaacagttctgacagagcagacagtttgagatctgtaacattctaatgagaatatctctaaggagaatatttggcttttctcactttctctgtagagaaacaaattgtcattcttctcttacagaggggcagtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacgttggggatgatgtatatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgagggtaaacacaagctttccatggaatcctgggaaaa

SEQ ID NO: 411163 - DNA, 1584 bp, Homo sapiens
gcagattagctagccttagatagatgtaaagaagacaacctgactcttttctgaaacattcagagcatcctctaccccgaggatcatgggaattccctcatgttcctcctgctctgcctcaagcaccccttctttgctgcacagcaagaaacagttctgacagagcagacagtttgagatctgtaacattctaatgagaatatctctaaggagaatatttggcttttctcactttctctgtagagaaacaaattgtcattcttctcttacagaggggcagtagagtgtgtctgggtcagctgagtgactacatcaaagctcccagccttgaaaaacacatgctgttcccaggcctcaagatattgaaacattaattagataatttaaagtagcgttttcttctacaatgtctgaagaagtgacctacgcgacactcacatttcaggattctgctggagcaaggaataaccgagatggaaataacctaagaaaaagagggcatccagctccatctcccatttggcgtcatgctgctctgggtctggtaactctttgcctgatgttgctgattgggctggtgacgttggggatgatgtatatctaatgacattaactcagattcagagaaattgagtcaacttcagaaaaccatccaacagcagcaggataacttatcccagcaactgggcaactccaacaacttgtccatggaggaggaatttctcaagtcacagatctccagtctactgaagaggcaggaacaaatggccatcaaactgtgccaagagctaatcattcatacttcagaccacagatgtaatccatgtcctaagatgtggcaatggtaccaaaatagttgctactattttacaacaaatgaggagaaaacctgggctaacagtagaaaggactgcatagacaagaactccaccctagtgaagatagacagtttggaagaaaaggattttcttatgtcacagccattactcatgttttcgttcttttggctgggattatcatgggactcctctggcagaagttggttctgggaagatggctctgttccctctccatccttgtacgtctctaactattgaggatttagtactaaagaacttgaccagatcaatggatccaaaggatgtgcttattttcaaaaaggaaatatttatatttctcgctgtagtgctgaaattttttggatttgcgagaagacagctgccccagtgaagactgaggatttggattagtatgcttcttccaaattctccaagaagtaagagacttgtgagtaagctcatatgaggaaagaggaaactacggtaccagagccaaaccagcttttaaaatgactgtgtatttacattatcagacaaatgaacttgtttaacagaacattctccagttccttgtctgacgtcttctgatttgatgttattattcggtcttaaaattatacctggggacaaaggggaatagccatactatggccctatgattgtctcagaatcatttcactgaatttctttgctttctcaaataaagactcctttctttcattattattatactgtcacgtgtgca

SEQ ID NO: 411164 - DNA, 984 bp, Homo sapiens
agactgcccttgtcatccacactgcagcaaaacttcaggaccttgaaccttgggctaataatttcacaactgagacggcttcatctacacccttggaactatacccattagaacccttaaggattttgaagccagccttatacatggataagcttataccttgatagatggaagatgaggcgcaatgaagctctgcaatgaattgaatatgtgagtgcctatgctgtgaagatgtagggatgctccctgtcctcaagatgctcacatccagaagaatgcattttaaaaggtctagatatggtgctagaaataaagctacaaaaataacacagatcaagacccaagctctctttacaagaaacttacaccaaagtaggggagacagatacgtaaataaccatcttgatgcagtgtaagaggggcaatgacagcagtaaccccagaatgttaagggaaacatgcaagggtgactacctggcctggaaaggtgagaaacaaaggtttgtgcaaggatgagtacttgctgcaggtccaacagttatgactggattggaacttcatcccagcttggcctaacttcagaggagtttcattcaacttatatagattcgatatgaaatgggaatgcaagaaggcatagatatttctggttgattcaatttcctgataattcccaattacaataaaagaaatggtttcataaggactcacatgtttgaaaaagtctttggatataaaatataaacctgagattaaatttgataatagaaaatttttgatgaagcataaattaaaaaatatttttctggcatttttttcctaaaaaaaagaagatcctgttccaaaaccaagccttcgtaaagaggtcctattcctatgtattttatgattggagatgtggaagtcactgtgatgtggtcaaagtagaaacatttgtgggttttttcttcttgaggaaataaaccaaaatgctaaaataaatga

SEQ ID NO: 411165 - DNA, 687 bp, Homo sapiens
agactgcccttgtcatccacactgcagcaaaacttcaggaccttgaaccttgggctaataatttcacaactgagacggcttcatctacacccttggaactatacccattagaacccttaaggattttgaagccagccttatacatggataagcttataccttgatagatggaagatgaggcgcaatgaaggtgagaaacaaaggtttgtgcaaggatgagtacttgctgcaggtccaacagttatgactggattggaacttcatcccagcttggcctaacttcagaggagtttcattcaacttatatagattcgatatgaaatgggaatgcaagaaggcatagatatttctggttgattcaatttcctgataattcccaattacaataaaagaaatggtttcataaggactcacatgtttgaaaaagtctttggatataaaatataaacctgagattaaatttgataatagaaaatttttgatgaagcataaattaaaaaatatttttctggcatttttttcctaaaaaaaagaagatcctgttccaaaaccaagccttcgtaaagaggtcctattcctatgtattttatgattggagatgtggaagtcactgtgatgtggtcaaagtagaaacatttgtgggttttttcttcttgaggaaataaaccaaaatgctaaaataaatga

SEQ ID NO: 411166 - DNA, 555 bp, Homo sapiens
ctcatttattctccgaacctcaaacaaccctacagggaacaaacaaagcctttttcaggtgagaaacaaaggtttgtgcaaggatgagtacttgctgcaggtccaacagttatgactggattggaacttcatcccagcttggcctaacttcagaggagtttcattcaacttatatagattcgatatgaaatgggaatgcaagaaggcatagatatttctggttgattcaatttcctgataattcccaattacaataaaagaaatggtttcataaggactcacatgtttgaaaaagtctttggatataaaatataaacctgagattaaatttgataatagaaaatttttgatgaagcataaattaaaaaatatttttctggcatttttttcctaaaaaaaagaagatcctgttccaaaaccaagccttcgtaaagaggtcctattcctatgtattttatgattggagatgtggaagtcactgtgatgtggtcaaagtagaaacatttgtgggttttttcttcttgaggaaataaaccaaaatgctaaaataaatga

SEQ ID NO: 411167 - DNA, 1252 bp, Homo sapiens
  misc_feature (998)..(998): n is a, c, g, or t
agactgcccttgtcatccacactgcagcaaaacttcaggaccttgaaccttgggctaataatttcacaactgagacggcttcatctacacccttggaactatacccattagaacccttaaggattttgaagccagccttatacatggataagcttataccttgatagatggaagatgaggcgcaatgaagctctgcaatgaattgaatatgtgagtgcctatgctgtgaagatgtagggatgctccctgtcctcaagatgctcacatccagaagaatgcattttaaaaggtctagatatggtgctagaaataaagctacaaaaataacacagatcaagacccaagctctctttacaagaaacttacaccaaagtaggggagacagatacgtaaataaccatcttgatgcagtgtaagaggggcaatgacagcagtaaccccagaatgttaagggaaacatgcaagggtgactacctggcctggaaaggtgagaaacaaaggtttgtgcaaggatgagtacttgctgcaggtccaacagttatgactggattggaacttcatcccagcttggcctaacttcagaggagtttcattcaacttatatagattcgatatgaaatgggaatgcaagaaggcatagatatttctggttgattcaatttcctgataattcccaattacaataaaagaaatggtttcataaggactcacatgtttgaaaaagtctttggatataaaatataaacctgagattaaatttgataatagaaaatttttgatgaagcataaattaaaaaatatttttctggcatttttttcctaaaaaaaagaagatcctgttccaaaaccaagccttcgtaaagaggtcctattcctatgtattttatgattggagatgtggaagtcactgtgatgtggtcaaagtagaaacatttgtgggttttttcttcttgaggaaataaaccaaaatgctaaaataaatgaaaaaaaaaatcggnctccttggcctcacccggtggagctatagagggcgctttcctttagagagggctaatccatgatccttgatcaatgacctccttccgctcagcccttcgaatgcggagagccaccaccaacccactaccagggcgatctaccgccatccccacaatattggaataccccaccaactaccacgtatcctaattgcctgcaattcgtcatgtatcgaaaaaggcccccttgctgcccttttccccctgcccaccca

SEQ ID NO: 411168 - DNA, 434 bp, Homo sapiens
aatgaccccacaccaaccaattctccaacactctgaacaccatcggggtatcgtgcaattccgttctgatcctaactaccaagagttagcacagaccccacaaggtgaaggctcagcccacaacactgcccccactgcagatgccaatcgcagcacctgaccgcccatacttctgactgactggctaaaattggaggttcctacaaaccccctcctcaggttagataatctgctacaagagttcacaggactcagggaggcactttactcatgattactggtttattacaaagagtacaactcaggaaaagccacgtggaagagacacacagggccatgtatgaggggcagcatggagctcccaggcccactccaggagcccacccttccggcaccccacctgctcagcagccctacagttctctgaaccccat

SEQ ID NO: 411169 - DNA, 179 bp, Homo sapiens
gctggagtgaaggattagtttttatgcaattccaagaagtcacgagttcatcctctaagctacagttaccaaaggcctaacttccaaggcaggaaagggcaggaggtttgccatttcagtggtacaactaggtaagaggtggtgcttaaaggacatacacagacaaatctaagatgaaa

SEQ ID NO: 411170 - DNA, 1378 bp, Homo sapiens
cggggactggaggcctctggccatggcgcctggagacggggtcgcgcagaccccggacacccgaggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcattccccacgatagcaaaaaaggtgatgtctggagcatgggtgtggtcctgtatgtcatgctctgtgccagcctaccttttgacgacacagacatccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacccaaaaacccgcttcta

SEQ ID NO: 411171 - DNA, 808 bp, Homo sapiens
cggggactggaggcctctggccatggcgcctggagacggggtcgcgcagaccccggacacccgaggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaaggtgagccggggcccctttggagggaaggagggaggactggctgaggtgggtgggtgcttcctcctgtttgttagaacgatcattcgatcattccctgctcccgctggcctggaaccaagcaaccctggtaccgagctcaattcactgcctctacacca

SEQ ID NO: 411172 - DNA, 1287 bp, Homo sapiens
cggggactggaggcctctggccatggcgcctggagacggggtcgcgcagaccccggacacccgaggggggcgcagcaggccagggcaacccgccgcgaggcggcgtccacgccgaggagccgcgcattcccggtccacacagacgcggcggagcgccctcccaggcgggactacaactcaatgcctggcacgggggcgggctcggcggtgacttaatccgggctgagtttggtggtggtagtgagggcaggtaggggcactgcccattttggccaagggtcacacagcatctacatcacaattgcaccggagtttaaaaatgtctggccctgtccctccccaccacccgccgctgtgtccagacagagaatgttctaacgctgggggcggctgcggatgaagtccttggggagaaaaggagcaggccaagggcgatggtggagtagagctgcctctcagaggcagcatgagctgagagggtgataggaaggcggcgctagacagcatggaggactttctgctctccaatgggtaccagctgggcaagaccattggggaagggacctactcaaaagtcaaagaagcattttccaaaaaacaccaaagaaaagtggcaattaaagttatagacaagatgggagggccagaagagtttatccagagattcctccctcgggagctccaaatcgtccgtaccctggaccacaagaacatcatccaggtgtatgagatgctggagtctgccgacgggaaaatctgcctggtgatggagctcgctgagggaggggatgtctttgactgcgtgctgaatggggggccactgcctgaaagccgggccaaggccctcttccgtcagatggttgaggccatccgctactgccatggctgtggtgtggcccaccgggacctcaaatgtgagaacgccttgttgcagggcttcaacctgaagctgactgactttggctttgccaaggtgttgcccaagtcacaccgggagctgagccagaccttctgcggcagtacagcctatgctgcccccgaggtgctgcagggcatatccccaagatgctgtggcagcagcagaagggggtgtccttccccactcatctgagcatctcggccgattgccaggacctgctcaagaggctcctggaacccgatatgatcctccggccttcaattgaagaagttagttggcatccatggctagcaagcacttgataaaagcaatggcaagtgctctccaataaagtagggggagaaagcaaacccaaaaacccgcttcta

SEQ ID NO: 411173 - DNA, 679 bp, Homo sapiens
accacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaaggccatccctttccgatgtcagcgtgctgtgcctctgttggtgtaaagcatttgtttctcctggaaagtgcacaacggggattttctaagaaatggaaaacgattgccacactcacatcagacggatcccacgtgaagcagagcgcagtccctttgtttcctcgttagcatcacccggctcccatatttgtagagctgtaataaaaacaacttcttaactgtgcgtcctgttggtttataccaaccatgtcaggtccataaaccatggtatattaaagtgtaatagactgtgtaaagaatactaggaagatactccaacccttatcccttccccttatttcacaatttactgcctcccagatgggcatccataaataggacttaattgcgtttggcataaaagccccactttctttaaagagtggcctcctccttcagccactctcattgtatgaatgccaccctcttgagaataaaaacttcggttatttgggtacatttaaa

SEQ ID NO: 411174 - DNA, 772 bp, Homo sapiens
accacaggatttctttctggcctcccaagtcaagtttgaagacctcataaaagatttgagaaaactgaagaggcaactagaagcaagtgagaaacagatggtggtggtgtgcaaggagtccccaaaggagtatctccagcctttcaaggacaaactagaggagttcttccaaaaaggtaggaagctttgtcagccgcacatacacgtggccctgaaacatccttcattccatgaatctttctctgaggcccacggcccctggcatcctggctgaccacaggcagctctggtgatttcattagccctatctttccatggtggttacatactcacggtagataaagttgtcctgtagctttcatatcacctttcaaatccagtttaatattttaaattcttgaatgttactctggcttttgtaaattctctgaggacaaacttttttgtctcttcatggggctcaaggaattccttagcccgtgtttactgacaaatgacatacatgtaaggcagatgtggtcatgcatttcacatttgtggtcaacctggacaggtggatggtgatcaccctcctggttttatgagtgtagcaacttggaaacttgtgttatattttccattccttttcagataggaaaattagggccaagtgaatgtcacccatcaatcacttgctacctatcagccctctgggggttagtcagtgaaagtgatgtggctggtatgcatgagactccacactttctttgaaatcttaacagatttccttcct

SEQ ID NO: 411175 - DNA, 376 bp, Homo sapiens
ttcttttacagtgaacaaattcttcccactcttctgagcaaccatctcaaaatataataaagatgctgccaagaaatgaagtgccacaaaaagaagaaaagacataagaagatactgccaccagaaaacactgggaacagaaaaagacacaaagtaaatagattgctggagatgcagtctggcatgtgctatgaaaacaatcaccaatttctgcacttgattagtctgcccgtcgcctcagccattgtcagccacattgcgttattcgaaaatgcattgcaatgtatttagagttatgaagtcttagagtttgtacttgattctgtaaataaattattattatggctattaaaactttttaaaagcaaattctcct

SEQ ID NO: 411176 - DNA, 497 bp, Homo sapiens
tgataagggcatcatggtaggatagctagaaatagcctaggggtcatttaaaatcttatttagcaaacagcttcaaccttttccaatattaaaactttaattagaactttcaatacctaaggaaaattttgctcatttattaatacatcttacctttttttgcctgaattatttaagataaagatgctgccaagaaatgaagtgccacaaaaagaagaaaagacataagaagatactgccaccagaaaacactgggaacagaaaaagacacaaagtaaatagattgctggagatgcagtctggcatgtgctatgaaaacaatcaccaatttctgcacttgattagtctgcccgtcgcctcagccattgtcagccacattgcgttattcgaaaatgcattgcaatgtatttagagttatgaagtcttagagtttgtacttgattctgtaaataaattattattatggctattaaaactttttaaaagcaaattctcct

SEQ ID NO: 411177 - DNA, 219 bp, Homo sapiens
tgcagtgcagtgggacaattgtgtaaactgccaccaccctaaccactgcttcccaaaggaccccatggatgttctcctctgagtccaagttacacaagcttgacaagcagaaagcatgtggcctctattttgcatttcatcttgctcataatagaaggtcttctttaacgggaaaagaaaatgtatggcaataaatctttaaaagtattgtaacattca

SEQ ID NO: 411178 - DNA, 1090 bp, Homo sapiens
ctctagagtcgagatccattgtgctctaccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411179 - DNA, 435 bp, Homo sapiens
ctagaggatccccgtcagacgctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagattagttcagcgtctgacgggtagcgagctcgatggtc

SEQ ID NO: 411180 - DNA, 1066 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctgggtaagtgttttccttttaattatcaattttatgcaagaaaggggatcttgatataaatatcataaacaagaacagactgtacactagagaaataagagaagggggaaaatgtattttccatgtacttgtttggatttgtttgttctttctttggttatttcagtaattgaaaatgagccaaggactcaaaaaagtgcacttcagaatgtgaggataaacatttcataaatgttttcatattgctgcaaaaaaaaatcacagaggaacacaaatgccccttaattaaaggacaattttccttagttgtatatcaagcaggcctccctaatttaaggactctgtggtaaaaacatggtctgattccatccggagcccgggtcctgattcccgcccttcacttctgggtttgaacaggtgaatcgcagggtgtgggacaataaagatcattttcagagcctcaaagacaaaaaaaatgggtcatgaaaaacttgagggggaaatgataaaattcctaaatcataagaaaatcaaactaagaccgtggatatatatatgtattggcattttaaagtcagtattttgatgtgtcatcaccctaccttttaattgacaggatttgtattttagcaatttgttatgtttctcttgaaagtccattgacatagacataaccaacaaattgataactgatatctatcaatagataatggaaaaacaaggtatgaaaagagcaggctgggatgttggg

SEQ ID NO: 411181 - DNA, 1168 bp, Homo sapiens
gttaatagcctttgcgatatttaaatgtgtgggttaatttttttatccagtttaataactttttattcctccctctacttctttgctttctctttctgctctgaagccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411182 - DNA, 1267 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttgacagatgcgacaagcaccgcggccgaataagcgacggtgtatgcgacgggggaaata

SEQ ID NO: 411183 - DNA, 1177 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagattagttcagcgtctgacgggtagcgagctcgatggtc

SEQ ID NO: 411184 - DNA, 949 bp, Homo sapiens
gtgaatagaaaaggtgatggacgtatagctgaacgtcaaagatacacctttagctgtccgcgggcccgccgtccttagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411185 - DNA, 1189 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411186 - DNA, 497 bp, Homo sapiens
ccctcacggattacctcaatcagacttagatttgaaaacagctcctaggatacctgtcgccacctgcaggagcaggatcagaagcaagcctaagctataatggaaaacaagtttacaaggacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411187 - DNA, 438 bp, Homo sapiens
gaacctctaatttcccaagagagatgagttagataagattggaactgtcaatatacaaaatcttttcatatataatgttctttctgtttatttataatgtgtccagtgttttcccttaaattccatgttaatcctgttattttgttctctagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgttt

SEQ ID NO: 411188 - DNA, 1211 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411189 - DNA, 848 bp, Homo sapiens
  misc_feature (793)..(793): n is a, c, g, or t
gttaatagcctttgcgatatttaaatgtgtgggttaatttttttatccagtttaataactttttattcctccctctacttctttgctttctctttctgctctgaagccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaagctttatggcacacacgttccacagagacggnttctttctaaagattctggcaacattgtttgttgggaagttgggggttggaaggg

SEQ ID NO: 411190 - DNA, 1506 bp, Homo sapiens
ggcttgtagtagagatagctgttcaggaggaggaaatgtgaattctgagagcgtgatcatttaggagagatttccattcctggaacgatatcactaccacatgcacgagtgcaattgaagggaaacctggtggggaaacagttttaacattctttcagaaaaagaatcactacctagtggaaaatgttgtgcaagcctcttcatgtttcttccctccagaaaacaactaaacagatggaagaactggttcacaaacatcccaactctctcctgccaaggtccagtgtgcttgttgctccagacctcatgccttctggacccagacatctctgcaatctcggaactggaatacaccacttcttgtcaaggtactagcaagttgactatgaactgctgggagataagaccatctgatttatccgtgtacatacagcagctagcacaccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411191 - DNA, 1010 bp, Homo sapiens
ggttgtgatagtatagtcgatgatgaactactgtcaccggatagataggagggtgtggaaatagagtttcatatgatcctaattgtattctttttgtttgtttgtttttttctgcagctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411192 - DNA, 817 bp, Homo sapiens
ggaaaagctttccggaaagacaacgtggcagtacagtgctggtgtgtttgggaactgagaagccttgggtatggcaggagaccggcaaaactgtttccagtaaatgatggaagatgaatccaagttttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411193 - DNA, 1163 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctggcatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacagggtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttga

SEQ ID NO: 411194 - DNA, 464 bp, Homo sapiens
cctgctcgcggatcccgagtagagaacgcaagcacccacgcccgcctgcaagctcccgggcgcccccggcctctcctgctcggcggaacgaggataacccagtagagccggacccaggggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgc

SEQ ID NO: 411195 - DNA, 524 bp, Homo sapiens
aacatctttcagatattattgataataaggcctctgtaaccatggctagttctgacgtaaaaccaaaatcagtaagtcatgccaaaaaatggtcagaagagatagaaaatctgtacagatttcaacaagcaggatatcgggatgaaaccgaatatagacaagtgaaacaagtttctatggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgc

SEQ ID NO: 411196 - DNA, 763 bp, Homo sapiens
cctgctcgcggatcccgagtagagaacgcaagcacccacgcccgcctgcaagctcccgggcgcccccggcctctcctgctcggcggaacgaggataacccagtagagccggacccaggggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgc

SEQ ID NO: 411197 - DNA, 735 bp, Homo sapiens
cctgctcgcggatcccgagtagagaacgcaagcacccacgcccgcctgcaagctcccgggcgcccccggcctctcctgctcggcggaacgaggataacccagtagagccggacccaggggtagatcgttggccggagacaggatatgtgaagaaacttcagagaagggacaatacgttctattactacaacaaacagagggaatgtgatgacaaagaagtccacaaaagacggggtttcaccatgttggccaagcgggtctcgaactcctggactcaagtgatcccagcgactcagcctcccagagttgagaagttgagaggggtcacagacaaaatgagagatttccacattcttgatgatggtgaattgtcacacaatccaaccgtgcagctgggaatccaacaggctaaggaaaaaggacaccaaaacgaagaagacacagagaaaaagatctcagtctaattgaaagaaattaagaagccgtgaaatacactctactttattctgacaccgtgctacaacttccattgatgtagaatatgtaaaaggacgacacgagagctacgaccccattatctgaaaacgaaatcgaaccttatagttctcaatgggaacaccttttcacatacctgttacttttcatatttattatcatccttcggttttctgacatcacttcttcataaaagtacatgcacacttaaaaaaaaaattcggcctctttggcctcagt

SEQ ID NO: 411198 - DNA, 799 bp, Homo sapiens
cctgctcgcggatcccgagtagagaacgcaagcacccacgcccgcctgcaagctcccgggcgcccccggcctctcctgctcggcggaacgaggataacccagtagagccggacccaggggcaagaaagtttcccagatcaaatggaaatgatcaagttgaaagtcaagaagaaaagaaagttcagagatgccaagggacatcaaaaggaaaaatgtctagaagtcaacaagcaaaggagcaacttagctgtcctaaggattgtcccatatcaagtagctcagctccagatgttcggaagaggcattggttgtactgttttctcaccggatcagatggctttcagataatctgctcctggccccaggagggaagagggctgtaatggagtcttgagaacacctcctttccctgccaaaggtagatcgttggccggagacaggatatgtgaagaaacttcagagaagggacaatacgttctattactacaacaaacagagggaatgtgatgacaaagaagtccacaaagtgaaaatttatgcttactagcctgtcttctttgtattacttgtcaattatattttaagtattcatcatttccttctacatcatgtgtttgtcatttgatgaaataattcaagatgcagtctgcagtttaatgttttgtgaaacacaaaagccatgagaattggtatctgctaatcaccttgtcctgttctaagaactggctgcagatgcattaaagttgtactttcttggtcctgccaaataaaagaaacaaacccgcctcgctggcctcat

SEQ ID NO: 411199 - DNA, 848 bp, Homo sapiens
cctgggaattacccatgtgatgtctccatgcctagcatagctgtgcctgatgcaaagcagatacttgctgaggaccaaagcagctacaggactgacctgcccaaaaccacacagtgagtctgcagcccggcttcggaccagagtttcttctgacaagcggcaagctcactgatggccacacccgctcatcctggataacagtattccccagtggaattaacacgatgcatcttcctggagtatcatttttactttaagatttaaaagcaagcaagcaaattaaatagtcatttaaatcatatttatattaagcctaacatggccatattgtagagcaaaccatcgggatttaataaacaaaacaggaaacttcaaagaatgctttttcttggaaagaaggcaggagagcaagaaaagcgactgcctcagcctttatcacgtgcgtcttgtggtttaaatgtattctctctcctttagagattttccagagggcaagtttttttttgtttttgtttttgttttttttttgagacactctgggatctgttagaagtgtgacggacaatagtgaactatcaattaataacattgttcatgactatgctgttaaataactttgagagatgtcagaaacatgccttgcagtttccattaatgtataatttaaaattgtctaaatacatgttaacagatcctttaatacaatagattttaactttttatcttagaaatttattttttgagctaatattaatagataatgtactcgattagtagtgtgtcacacgaataaatgcattttgcattcattcaaggttatctttaaaatgatgtgagtaatctgtttc

SEQ ID NO: 411200 - DNA, 599 bp, Homo sapiens
cctgggaattacccatgtgatgtctccatgcctagcatagctgtgcctgatgcaaagcagatacttgctgaggaccaaagcagctacaggactgacctgcccaaaaccacacagtgagtctgcagcccggcttcggaccagagtttcttctgacaagcggcaagctcactgatggccacacccgctcatcctggataacagtattccccagtggaattaacacgatgcatcttcctggagtatcatttttactttaagatttaaaagcaagcaagcaaattaaatagtcatttaaatcatatttatattaagcctaacatggccatattgtagagcaaaccatcgggatttaataaacaaaacaggaaacttcaaagaatgctttttcttggaaagaaggcaggagagcaagaaaagcgactgcctcagcctttatcactctccagaccagtgccaaggagccaaagagaagaaatgagaataaacaaggtatgctgtgtccaattaattaactattagcaaacaaaggaccaaacaatgtgactgtaagcttcatgacagcagggagtttgtatatcttttcacctgtgtatcggcag

SEQ ID NO: 411201 - DNA, 327 bp, Homo sapiens
actgttttaaagaagaggcatggggaagaagagagctccccgcttctaaactatgtgagctgccacgaccccaacaacaatgcccctttgaggtggccagacgtccagtatcagatcttgggcggccggacagcaaaccagatcattttcggccacaatggcttttatgtcttctacatttcgatcgtggatccgtactacagctactgtcaactggagaccatctttagcatctacgtgtatggagcattccccgtgcagctggtctctgctggagtcgtcatcctactgatcatctccagcatcctggggtccgtttggctggcc

SEQ ID NO: 411202 - DNA, 200 bp, Homo sapiens
gcatgtgtgtatttgtaagagagagaactaaaagtataaagtttttgtgtgcgattgatgttaagttgttatcagcctaaaatagatggttagcactatgcattttgtaacactattctaagcctcatggtaaccacaaagaaaaaacatacagttgatatggaaaatataaagagaaaagaatcaaagcatgctattac

SEQ ID NO: 411203 - DNA, 355 bp, Homo sapiens
tttaatgacactagggaaaagccaaggaccaaaatccaactgtgctggaggcagcatgacatcaggtcatctccaaccccctgggctataccttggcagcctcctaacaaacaatcccctctgggtggttgaggaagggtaaatgtgtctcaggtctccttctccgaactgcaaaaagttctgctgttagaagtggtcactggctgtgagtgaaattcatcttaagcacttttatgttgtaagatttgtgtacacatctaataacttaaagactatttctagcgttgttttcaactacaaatgagttcaaacttgtattcaactgacctagaaataaatttttctggaacagagt

SEQ ID NO: 411204 - DNA, 168 bp, Homo sapiens
attgcccagactggttgtgaactcctgggctcaagtgatcctcttgtcttggcctcccaagatgctggacttataggcatgaaccaccgtgtcccatcagcctttttaatatcaaggccaagaatacactattagactttgtatacttaaaatatctaaaattgcttc

SEQ ID NO: 411205 - DNA, 343 bp, Homo sapiens
gtgggaccaccaccattgtggatctggaaggctgcctcagtgggcctggaagcagagcatttaatgaactaaaaatgatttttcttgagccttaagatctcatggagtttgccttgtagtttggatgtaatttggatctgctattcctttcttctttcctatttctcccttttggaatggtctatcctatgcctgtctcaccattgtattttggaagcagataacttgcttgatttcacaggctcaccgctggagaacaatttgccccaggatgcatcacaccttgagtctcagccatatctgacttagatgacacttagataataaaactttggattttaga

SEQ ID NO: 411206 - DNA, 441 bp, Homo sapiens
agtgaaacatgagtggacatcaaagaacaagatccagatctagagaaagaagagatgatcaagactctaatcatccagtaggggctgtggttgcccaggagctgcccagtgatgaccagcttcaacaagaggaaccaccaattgaaagtcaggattatacacctggtcaagagagagacgagggagcactggacttccaagtgctaggcctggcagcctatctctgggaactgactcggtcaaagactgggggtgaacgtggagatggtcctaatgtcaagggagaatttctgccaaatctggagcctgttaaaataccagaagcaggtgaagggcaaccatcggtttaaatgaagacaagctgaaaccatacatgcagtctttatgttggaaacttcaccagtaaaattctctcaataaagtttcacaattgtctgcaaa

SEQ ID NO: 411207 - DNA, 929 bp, Homo sapiens
ttctccctcaggaatgcctgttactatgcatctaacaaaggactaaaatccagaatctacaaggaactaaactcaacaagaaaaaataatctcattaacaagtggggaaaagataggaacagacatttctcaaaagaagatatacaagaggacaagaaacataaaataaaatgctcaatatcactaaccgtcagtgaaatgcaagttaaaaccacaatgagatgccacatcacaccggtcggaatggccattattaaaaagtcaaaaaaccacagatgtcgacaaagatgcagagaaaagggagcacttatacaccgttggtgcgaatatgaattagtacaacctctatggacaacagtatagagatttctcaaagaagtaaaaatagaaccaccattaggcccagcaatcccactactgggtatctacccaaagaaagagaaattgttatatatatatacatctgcactcatatgtttatcactgcactagtcgcagtaacaaagtcatggaatgaacctaagtttccatcaaaagatgattggataaagaaaatgtggaataccatgaaatactacacatccgtagaaaaaaaattatgtcttctgcagcaacatggatgtaactggaggtcaaaatactcagaaacacaacatcaaataccacatgttctcacttataaatgggagacatgtacaaacagagaaaaatagtcaaggctggggactttaaaagaggggcttgggagggacttgagagttgaaaaattacctactggatacaatgttcattattcaggtaataggaacattagaagcccaaatctcagctttccacaatatatccatgtgacaaatctgcatatatacccactgaatctataaaaataaaatgaataaattttaaaaagcatgtttcaacacttcaaa

SEQ ID NO: 411208 - DNA, 476 bp, Homo sapiens
ttacaaatacaacacattatcatctttaagttatgagcatgctaattctccaaatggagaactactacttgattactcctgtgagttctatttcactttacaataataattctcctctttctccagtggtatttctttgtcctgcaccattgtcctagggtttcattttggtcttgctgtctactttatctttctaattattacatcagcatttcttctctggtttctcagtgctcctatacaggattcagtcatttttatagatttaaaaacttaatttcttgttttttcagatggagtctctttctgtcacccaggctggagtgcagtggcgcaatctcggctcactgcaacctctgcctcccaggttcaagtgattctcctgggaggtggaggttgcggtgagccgagatcacgttattggactccagcctggacaacacaatgaaactcttcctcagggggaaaaaaaaaaa

SEQ ID NO: 411209 - DNA, 684 bp, Homo sapiens
acaacaaaatttctagcttggaatttttgttctctactgttttctaaaaggtatcccaagagaggggataaagaattattcatatcttaaaaaacgaagaaatgaagattgtgtcagttctcctgaaatagatctgtagatccaattcagtatcaatgaacatcttaaaaggtttttttctggaaagtgacaaattgattcaaaattttaaaaaaggaggatcagttggagggctcacactaattcaaagctattatatattcatcaagacagtgtggtaatggtttaaaaacatacaaatatattgatggcacaggatagagagtccagaagtagacccacatacatacagttagtcttttttctcccttttaacaaaagtgccaaagcaattcaatggggaaagtcttcaagaacttgtgctgaaacaactggatgatctgtgtaggaaaaaaaacgaacctaacttagctgacaccatacacaaaaatattgatttgagatggattgtgtacctagacataaaagataaatctctgacgcttttagaagaaaacatagggaaatataatctttattttgtgacaggcaaatatttcctctagagggtcacaaaaagtaactaataagggaaaaaaattgacaaactggacttcatcaaaattaatcatctttttgttcatc

SEQ ID NO: 411210 - DNA, 465 bp, Homo sapiens
tatgccacattcttttgagaaaagagcttcaatatcatggtgggaaccagaggccaatgatcacccaaaattaaaaggccaaccgcgtattcgcagcagttgtgatgggaggggttaatatttttattgaaagagtttctgtgacaaataatccctcttaaaacccagtagaagctgggcgtggtggctcacgcctgtaatcccagcactttgggaggccgaggcgggtggatcacgaggtcaggagatcgagaccatcctggctaacacggtgaaaccccatctctactgaaaatacaaaaaattagccgggcgtggtggcaggcgcctgtagtcccagctacttgggaggttgaggcaggagaatggcgtgaacccgggaggcggagcttgcagtgagctgagattgtgccactgcactccatcctgggtgacagagcaagactccgtctcaaaaaaaaaaaa

SEQ ID NO: 411211 - DNA, 259 bp, Homo sapiens
tttctgctttcctaggtaaacagtagcatcctacatacgcttttattactttgttaataccctagtttctgacaaattattgttcatctttcttaaaattgcagtgttcttcaggcttgatcttccctcttgttgaaataagttgttgatgggtatcatcagaagtctaacctaaatgaaaatgagtttttgtttttgtttttgttttgagacactgtctagcctgggcaacagagtgagactctgtcaaaaaaaaatt

SEQ ID NO: 411212 - DNA, 610 bp, Homo sapiens
ccagtattctcttgtctttgtggtgatgtggagggacccactgaccagaagatacatcattgcctgaacactggcaggaaaggaagagctgccaagtaccaaccagaatctaaacggagattgttgaaggatggaagaagaaattagatataggctgtcagtgcacatattttttgcattaaattataaacaatatgctgttaatatttaaatcacggaggaataccagaagagaaaatatgtgtccttgtttttctatcatttcactttctcctcaccatgtcaatatcaaaagtatactgtgtctttgtactccatgtcatcaggcatatgcctatctgcaagtacacaacactgcagagatgttaaaggcaaataagaagcattcagaaaacttcatgaacatcaaatgtcaattgcaacacaagattttgatacaactcttgatttgactggattacttcccaaccctcagtaatgctccattgtgggagcctgtgtctcaacagttcacacctgccgtttactccactgggttgtgaagattcacagaagatgacaggaaggggggataaataagctaaaataaactttagaggatggccccatt

SEQ ID NO: 411213 - DNA, 400 bp, Homo sapiens
tattctcttgtctttgtggtgatgtggagggacccactgaccagaagatacatcattgcctgaacactggcaggaaaggaagagctgccaagtaccaaccagaatctaaacggagattgttgaaggatggaagaagaaattagatataggctgtcagtgcacatattttttgcattaaattataaacaatatgctgttaatatttaaatcacggaggaataccagaagagaaaatatgtgtccttgtttttctatcatttcactttctcctcaccatgtcaatatcaaaagtatactgtgtctttgtactccatgtcatcaggcatatgcctatctgcaagtacacaacactgcagagatggtaagacaaaagctttattaaatttaatgcccgatgcag

SEQ ID NO: 411214 - DNA, 493 bp, Homo sapiens
ttgtaaagttcttcagtgatttaaatgtgtatctgcaatgtgtaatgggatgtttctacagagtaaactgatagacctttcaaagtggctataaaatgaatgactaggagtgacatttataactgcattgctgatagtaataggtaatgttaaagcctttgtctttgtcaaacagaatcaatcttgttaaattagaaatgaggagtgatcctgtaaggtgtatacctatcatatctaaggcatacacacacaagcctcacttccttctttttctccctgactctcttacgagtgctcctaaactcataagcatttctcttaagggaatgtccttggaactccagcagtatctctcttacttcagtttaccacctgctgggctctcagcttctgtggttctggtaattcatgtaacaggaagcccaaggtgatttttaaatagcaacatccaatatattaataagaccatatattgaaaagctaagttttgaaa

SEQ ID NO: 411215 - DNA, 3624 bp, Homo sapiens
  misc_feature (2)..(2): n is a, c, g, or t
  misc_feature (4)..(4): n is a, c, g, or t
  misc_feature (8)..(8): n is a, c, g, or t
ananaatncggccaggctcatgcctgtaatcccagcactttgggaggccgaggcgggaggatcgcttgtgcccaggagttggagaccagcctgggcaacatagcgctatggagtctaatccaggcactttggaaggctgaggctggaggatcgattgaggccaggagtttgggaccaccctgggcaacatagcaagatctcatttctgaaaaaagaattatcatccactcacccagaacagctctccaaacttaacagccgtggcagtcagagctctgcctgcagtgtgaccatggacagctctccaaagcttaaacttcagtaaattgactcaagtttcttcggaaagaactgttacataaagaaaggatgatatctctaaaggtatgtggattcatccaaatttggagccagaagactgggatgactaagctgaaagaagctctcattgaaacagtgcaaagacaaaaggaaattaaactggtggtcactttcaaatctggaaaatttataagaatttttcagctgagcaacaacattagaagtgtggtccttagacattgtaaaaaaagacaaagtcacctgcgtttaactttgaaaaacaacgtgttcttgtttattgacaaattatcctacagagatgctaaacagttgaatatgttcctggacataatccaccaaaacaaatctcagcaacccatgaaatctgatgatgattggagtgtgtttgaaagcaggaatatgctgaaggaaattgacaaaacttcattttacagcatttgtaacaagccaagttatcagaagatgcctttgtttatgtcaaaatcaccaacacatgtgaaaaaggggatattagaaaatcaaggtgggaaggggcaaaacacactatcatctgatgtacagacaaatgaggacattctgaaggaagataaccctgtaccaaacaagaaatataagacagattccttgaaatatatacaaagcaataggaagaacccatcaagtttagaggatttagaaaaagatagagatttgaaactcgggccttcattcaataccaactgtaatggaaatcctaacctagatgagactgttcttgcaacccagactctcaatgccaaaaatggtttgacatctccattggaaccagagcacagccagggtgacccaagatgcaacaaagcccaggtgcctcttgactctcattcacagcaactgcagcaggggttccccaatttgggaaacacctgttacatgaatgcagttttacaatcgctatttgcaattccatcttttgctgatgacttactcactcaaggtgtcccatgggaatatattccctttgaggctcttattatgaccttgacccagctgcttgctttgaaagatttctgtagtacaaagatcaagagagaattacttgggaatgttaaaaaagtcatttcagcagttgcagaaatattttctggcaacatgcagaatgatgctcatgagtttttaggtcagtgtttagaccagctgaaagaagacatggaaaaattaaatgccactttgaatactgggaaagaatgtggggatgaaaattcatctccacaaatgcatgttggtagtgctgccaccaaagtgtttgtttgccctgttgttgctaattttgagtttgaattgcagctctcccttatttgtaaagcttgtggtcatgctgttctcaaggtagaacctaataattatctctccatcaacctgcaccaagaaacaaaaccacttcctttgtccattcagaattctttagatcttttctttaaagaagaagagcttgaatataactgtcagatgtgtaagcagaagagttgtgttgcaaggcatacatttagtaggctctccagggtccttatcattcatctgaaacgctatagcttcaacaatgcttggttgctggtgaagaataacgagcaagtttatattcccaaatctttaagtttatcttcttattgcaatgaaagcaccaaaccacctcttcccttgagcagtagtgcacctgttgggaaatgtgaagtcctggaagtctctcaggagatgatttctgagatcaacagcccattgacaccatcaatgaagctgacctcagaatccagtgattccctggttctacccgttgaaccagacaagaatgccgacctacaaagattccagagagactgtggagatgcaagccaagagcagcatcagagagacctggaaaatggctctgcactagagtcagaattggtccactttagagatagggcaatcggtgaaaaggagcttccagtggctgactcactgatggaccagggagacatttctcttcctgtgatgtatgaagatggagggaagctgatcagcagcccagacacaaggcttgtcgaggttcatcttcaagaggtgcctcaacatccagaacttcagaagtatgagaaaaccaatacattcgtagagttcaattttgacagtgtcactgagtccaccaatggcttttatgactgtaaagaaaacaggattccagaaggatctcaaggaatggctgaacagctccagcagtgtattgaggagagcatcatagatgaatttcttcagcaggcaccacctccaggtgttaggaagctggatgcccaggaacatacagaagagaccctcaatcagtctacagaattaagacttcaaaaggctgacctgaatcaccttggggcactgggttctgacaacccaggaaacaaaaacattttagatgcagagaacacaagaggtgaagccaaggaactaacaagaaacgtgaagatgggggatcctctccaggcctacagactcatcagtgttgtcagccatatcgggagctccccaaattcaggccattacatcagcgatgtgtatgactttcagaagcaggcctggttcacatacaacgatctatgtgtatcagaaatctcagagaccaaaatgcaggaggcgaggcttcactctgggtatatcttcttttacatgcacaatgggatttttgaggagctgttaagaaaagcagagaactctcggctacctagcacacaggcaggggtgatccctcagggggaatacgaaggtgactctttgtacagacctgcttgacagactcactcggcctcacttcatccttgcaaagagaatcctgtacttcatccttgcaaagagaatcctgtacttcactcagaatgaaggaacaagtatctcaggatgaaatctcaatgaaaaacacttattttgggggaatatctattttaactgcttcagacacctagatcccagaactcaggcgcatatgcatattttccctgcaagattagaatggtgctcttcacgttttgacggtggttttcaaaatgttgttcttcaaccagcaacagcaacagctagggactgattagaaatgcaaattcttgggtcactctctagaccaactgatgcagaaacaggaggtgtgagccagcaatcagatggagattctagtgctcatgaaagtttgaagaacactggtaatgtgtggagtatcttggtgtattttgctactgttgatatggattgcttatgttatataaacgattttcattaaatttt

SEQ ID NO: 411216 - DNA, 440 bp, Homo sapiens
tatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttccttccggaaagcttgctttgaaaaacttaaaaagcccccgtttacatgtaggcaggactgtgataacagtgcaagctctgtgttgacaagagttgtggacaaaaagccaaaataaatattcttcctgatta

SEQ ID NO: 411217 - DNA, 376 bp, Homo sapiens
tagggaatatggaggggattgatatgatttagttacattgcagatggaaaaggacatggagccagttcgtaacatctcgtttacctaagcgatgccgacctgtttgtttgttttttataaactagctatatatctgggtcacatttcatctctgccaataatatgccttaaagtaggtggtttcctatgactgcctgctttctgagatgattatagaaacaatacacgaggaaggatgccaggttgatgattgattttaaaatacgcaggtttttagccttacagaaactgctcaatttgcattttatctcatttcttaaaaatgtttccagtggatatttgttctctgtgagaatgcagttctattttattattt

SEQ ID NO: 411218 - DNA, 911 bp, Homo sapiens
gaacatagtaaacaaaatcaatcttcctaccaggtaagaaaaaaatccttaaattgtgtcttgcacatctgctgaaaaagagacggaaagcctatgggagcaggacattgagaccatcctgattagaggaccaggactagtaaagaggatctcttactaatgaattagaaaagcagcagcagagaggaaatcatgaagaaatagtgtaataggactagagatgttagtaggtaaggaactaaaagggcatcaaaatgatcctcagtgttttcatgttgaggcacattccttcctctccctacctcactcctcatttcccacttctctctcttgcttctctacatctttaccacatactctctttatcctccagctttagatgtctgtcttaagttgatatctattcattttcatacctctacccactttcccaaaacataagaatctctttagctgtgtaaaaaaaaggtagtaacataaatctggataataattagaaattgtggaataacaagaaggtcattctcacaagtgagaagtgagggggaaattttaagagagtcaaacttctaccttaagaaatacagtagaaatgagagtgaattttgaaattaaagaaattggcatgtaattgatctttattttcaaaggagcaggtgtttttggtaggaactacatgataggattgattcagcagttggggttaccaggcctcacttagtagagaagagcaaatgcatgagaaggtcatcctctgggttttgagaatccaacacttcaggctctattatgaactattcccttcctcttccattcttaaggtgtgacttcaaaagaataactattaataatataatcttctatgacagtatataagtagagaatgtttaataaatcctaattgccattgc

SEQ ID NO: 411219 - DNA, 335 bp, Homo sapiens
gatgaaaaaccaaacatcatatgttctcactgttatgtaagagctaagctatgaggacgcaaatgcataagaatgatgcattggactttggggacttggggggacgagtgggaggggggcaagggatagaagactacaaatatggtgcagtatatactgcttgggtgatgagtgcaccagaatctcacaaatcaccactaaagaacttaggtaaccaaataccacctgtacaatagcttatggaaaaataaaaaaataaaagcaataaaaaaagaaaggctagaaattaatacaatgtccaatcataccacagtggatataaactagaaatcagt

SEQ ID NO: 411220 - DNA, 422 bp, Homo sapiens
atccaggctttttatcaggagttagtttggtacctagcatgaaccaaaatttcaggctcccagtaggaaaacaggtgttctgcatgaaccgcatggtaggtagagtttagacacagtaaaccacccttatcaattagagaatggtggaaacaatcctgaaatttagattcccagatgccacccaagagccaacctttttgcaagccgacttttccaaggatagtagcctctggttatgctgtttgaattctttttggtacactttgtataactgaatcctttaaaatgtattgagatttgttttatggtacagaatatggtctatctaggtaaatattatttgtgcatttgaaaggaacgtatgtccactgctctccagcctcggtgacagagtgaaggtcgctctgtctcaaaaaaaaaaa

SEQ ID NO: 411221 - DNA, 146 bp, Homo sapiens
atgtagactccctcaccactctgagcctgagctacctcatcagttaaaatggaagacggacaaagagaacttctcctgagaggctccgtttttgagaactcaatgacgtaatccacacaggaggcctccccagtgccaggcatgtg

SEQ ID NO: 411222 - DNA, 427 bp, Homo sapiens
atgtattcagatcacagcaaactcaagatggggaaaaatagatctgaaaagacttcctcttggagagtcacaatatataagatatactgaaactctgaaaagtcttacaataaagctgtttgattttgtttaatctagtctttctcaaaacttatttaactacagaattcttttttggtaacatccgttaacattttaggaagttctgttgatcaaactttgtgaaaagtgctctaatatttttatttttgtattaattgatacatattatgcataaaaataattcatttgattttaaaagattatagattcataaaattttgattcagtctacaaagcacaaagcctcctaaggtgatttttactattatattcttagttctattagcctgattgtaggaattttaagatttgctgtacctctgga

SEQ ID NO: 411223 - DNA, 160 bp, Homo sapiens
agagctttgggtcttctcactagcggagtgaggatgagggtgtgctgaccacagcaaggttgtgtgcgtgcctccatggaggtgcgcagagcagaaacgctgcccctcgcactgccatggtggtaaggagaggaaataaaacccatgtcttttcaaagat

SEQ ID NO: 411224 - DNA, 510 bp, Homo sapiens
ccaggctgatatggtttggctcgtgtcactgcccaaatctcatgataaattgtaatcatcactgttggaggaggggcctggtaggtgactggatcctgggggtgaacataccccttactgttctcatgatagtgagtgagttctcataagatctggtttaaagtgtatagcacttcccccttcgcttgtcctctctctcctgctccatcatgtgaagatcgtgcctccttcctcttccccttctgccatgattctaagtttcctgaggcctctgcagccaagcctcctgtacagcctgcaaaactatgagtcaattaaacctcttttctccataaactacccagtctcaggtatgtctttgtagtagtaggagaatggattaacacacaggccctcctaaacacatctaggataataccctgcaataggctgctgtgagactgagttgtgagcaggccacattccacaaaacttcttcccacactgcttacctgggaggatccctgcccc

SEQ ID NO: 411225 - DNA, 318 bp, Homo sapiens
cctgctcagccctggagttggtcatttctccaagacaccatgactcctgagtggacagtggtacttggaaaccaagatctaggtaatagatgtgttctttgctattggggcttccaatcttttttcatatgcattttttacttagtcatattaactagatatttgcaattttgaatcttgtgttttctacttttaaatctttttcatattaatactcaaaaatgtttaatggttgtataatatttctttcagtggaaataatataatatggtcttggtttgtttcatatttttcataattaaaaaaacctggaataaa

SEQ ID NO: 411226 - DNA, 428 bp, Homo sapiens
gaggccgagtaggggcttagtaaaggcagagtgaattcatgaatgggatcaaagctagagccatagtcttgtgccaagaaactgagtggcgctaaactgctgatttgggaggtcagaatcttgttctgggctttattagcatttcgctcaagtcaagcgaatcaccttgtcaagtcatatgcagagaaggcagaacatgacgttggaggaaagaaaacattctacacagtttaaacacagggcctttgtaaagtagtgttaggatcacttaacgtggtttatggaaccaagattttttgctgtgaaatgactttcagaaagtctttacagaattgaaatcctgtcatttcagtgtagaacaatgtacaaaaaaagtttagaaaatatatttctggatatagaagtaaaaatttgccatgggaaattgc

SEQ ID NO: 411227 - DNA, 294 bp, Homo sapiens
ggacttctacatacatttttaggggacacaattcaacccataaaaccatttgtcctcaagatgcttccaattcagtgagggagactgatggaaaagatgatggaatcagtgctacaaggggccggagcactgtgctgaagagtccaagggaggacacacacacacacacacacacccatgcacacacacccccacacacaccccactccaccccacactaaacacacatctatcacatgatgtagaatcggtccattctaaatgctctgtgggtgagtttgccctggcatgtgg

SEQ ID NO: 411228 - DNA, 317 bp, Homo sapiens
aaatgcaggtgcaatgtgtgtgagcaagtgtgtttgaaagtgtatgtatttgagaccaagtgcagtggctcacacctgtaatctcagcactttgggaggctgaggcaggtggatcacttgaggctaggagtttgagacctgcttggccaacacggcaaaaccctgtctctactaaaaatgcaaagattagccaggcatagtggtgcatgcctgtagtcccagctactcaggaggctgaggcaggagagttgcttgaacccgggaggaggttgcagtgagctgagatcgcgccactgcactccagcctgggcaacaaa

SEQ ID NO: 411229 - DNA, 397 bp, Homo sapiens
tatttaatttctccactgggatgtatctgaagtatctcaaatttaaaacacgtaaagtgaattactgattctacaacaactattcccctaccaaaataaaaccaacttgccccacccctagtctctcccaacttaattaggtagtgccatctcttgaaacacctagtcattcaagatagaaacttgggactttatccttaattccttcttgagaaacattcacagattgaattaaagaatccctctcctagagagaaagcaaacgaggaaaaagcattagcagttattgaatttaggtacaggtacctgggcaattgtacacttcttctcacttttctatatgcttgaaagctttcaaataaaaatttatggagaaaatttttttttaactaaaaaa

SEQ ID NO: 411230 - DNA, 257 bp, Homo sapiens
tcggcttttcacatttcattcagactgtttaagagacattggattggagcagaaaacttgttacaaacctttttgtcccatcacaggtttgtattaagcacaggattcctcaaacatcctattactctatcagattatccctttgataagaaactttaaaatctgagaggaaccctcaaaaaaaaatcattaacctaggttaaaaactttctaactacaaatacaagtctcagaaaggaaaagaatttccaacttgg

SEQ ID NO: 411231 - DNA, 388 bp, Homo sapiens
ttcattcatgaaatatattttcagtatcacctgcatgctaggagctagggagatggtagtaagcagaacagatggaaattcctgacgtcttgaagcttatgtttttctagaataatatcgaatgggacatagttggtgtttcctgtgtgcctggcattgttctagaagctttccatatattaactcatttaatcctcaccatatttattccataaggatagataggattgccatttacatgtgtctggtgttaacagtggctctcagagcaccttgttgcttgtcctcattggatggcatccccgtcaacctgatattggtcgagagctcaggtacaatagcagcgttcagaacctctctgtgtcactgagtgaggctctgttaggtg

SEQ ID NO: 411232 - DNA, 551 bp, Homo sapiens
atgctatatcttccacatagcagtgtgaaattagagaattgtatgcaaaaaggatactgcagtgttatcagttataaatagggctggaaaaatctaagcatacattgttataaataaattgttaattcaatattaatgaaaaacttagtatattcaactgcaactatcaccacaaagtatagattgaaaaatatataaaatgtagtttgaaaaaggcctattgcccttctccttgggaagaactgcattgagtattcttggatttgggttgtgtttccagaggtgatttctttctgatacttacctattcttaccagacctgccttcagaacaagagggttgcttaaggggctggagtttcaatatgtgaccacccaggaggaaatataaattgacaggcacttctgtatggaagtctgtcttaggaattgtcaatattgtactcaacaacactataaactacaaggttctgcaaagctaatcataacaaagccttatgatatataggccttgattgagactaggtgaattttaccagaaagtaaaaaaaa

SEQ ID NO: 411233 - DNA, 553 bp, Homo sapiens
gagatgaggtcagagtgggaggtgcggccagatcattctgggtattataggccatggtcaagagtttgtattttatttcacataaaatatattttggggaggtattggagagttttcagcaagagaatgacctatctttgggggttgaatcacaagcctaccgataatgtaaactgccacagtcagttcctgccctgacagaccaagctctcttccttgatggtgggcaaatttggggttgctccctattttaaaaccattgccacccgtagtccccactgtagaatttccttaggtggccatattatatactacgtgaactctggcttccttggttttatacctcatgggctgagttgttaagattcctactcttttccggcattggggttgggggtgttagggaacagggtctcactctgtcacctaggctgaagagcagaggtgtgatcacagctcactgtaaccttgaactgctgggctcaagcagtcctcccgcctcagccttccaaggagctaggattacaggtgtgcaccatgacccagctaatta

SEQ ID NO: 411234 - DNA, 352 bp, Homo sapiens
gctggcggccagtccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactggtagcgcgggccaaataaactgtgacctgggcga

SEQ ID NO: 411235 - DNA, 2932 bp, Homo sapiens
gctccgcgccgagggctggaggatgcgttccctggggtccggacttatgaaaatatgcatcagtttaatactgtcttggaattcatgagatggaagcataggtcaaagctgtttggagaaaatcagaagtacagttttatctagccacatcttggaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgactcagctatacatttacatcagattattgggagcctatttgttcatcatttctcgtgttcaaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcataactaatggacattgctttgccatcatagaagaagatgaccagggagaaaccacattagcttcagggtgtatgaaatatgaaggatctgattttcagtgcaaagattctccaaaagcccagctacgccggacaatagaatgttgtcggaccaatttatgtaaccagtatttgcaacccacactgccccctgttgtcataggtccgttttttgatggcagcattcgatggctggttttgctcatttctatggctgtctgcataattgctatgatcatcttctccagctgcttttgttacaaacattattgcaagagcatctcaagcagacgtcgttacaatcgtgatttggaacaggatgaagcatttattccagttggagaatcactaaaagaccttattgaccagtcacaaagttctggtagtgggtctggactacctttattggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcaccc

SEQ ID NO: 411236 - DNA, 617 bp, Homo sapiens
gcttggagaggggcattctcaccatatttagcaagaacatttcaggactgtgggcctgcgctggctctgtcatggagtgccatgcctgggctgggacaggtgagtgtggacagcaccctccctacacacacacacacagacacacacacacacgccctgctgcctcacatgggagagagagcctgggtccctttgcccacaggctttccgggtcccttctaagccaaaaagaaggacactgttttaatcagagcttcgtcccgttggtagtggttggtttttattgtggtggtagatgtataacattaagaagagaaacaagcactgtaaaacctttaaaacatcctgaaatgctaataaaattagttctagggtttcatggtagtttttaaaagtgccatgtttatgaagtgcctgcttctgaaaataaggaagcatttcagtcaaacaatgttgactatggaaagagttttgttgcagtttctttctgagctttccttgcccaccaaaataagttgatatttgcggtgattatgttgggtcttagcagggtctaagctgtgtcacgttgtggtttttagagccaaaacaagtgaatgctgagtcggttttctgtg

SEQ ID NO: 411237 - DNA, 406 bp, Homo sapiens
gtctcaaactcccgacctcaggtgatccgcccgcctcagcctcccaaagtgctgggcttacaggcgtgagccaccacgtccagcccatacatttcaattttaaagggatgcgccctagtccttagttagtctctcctcatctctataaaatgttcagctactcacctcttgggctattgctagacatcgttttctcttccttctttctgacgcctacaatagataggacattccccctcctcattctattctcccaagtactttaaattgcaatttataaagtttctatgctacactctaaaaaaaattctgttttgttttctaatttcataattggtgcttcactgtgtcttgtcctcgaaggaatgagtattttgattgtgttcattaaatctgatttttctat

SEQ ID NO: 411238 - DNA, 364 bp, Homo sapiens
gaaaaattatttttctaacttgacctattaacaccttaaaaatggacaccgtcacccatttggctccttcaatgtcaaatcctaatttgaatgtgacagatatttagccatcagtgaaaatatcagccaggctggtggctcatgcctgtaatcccagcattttgggaggccgaggcaggaggttcacttgaacccagaagtttaaaaccaccctggccaacatggtgagaccaaaaaataataaaaatgtaatcaaccaagcgtggtggtgcacacctgtagtcctagctacttgggaggctgaggatagcttgagtccagaagtttgaggcttcagtgagctatgagaccctgtctccagaaa

SEQ ID NO: 411239 - DNA, 616 bp, Homo sapiens
caaagacaaaaaaatggtgggattgatttattttcccctgacagaattgattgtttctttaggttctatgcaacttgcagactcactgagggtgaatggaatgtgctgaaaattcagcctgacttggcagctccaagggacacacctcaatgtagagaaagcaggaattagagatgaggttttttaatccctgtctcagttttgccttatagatgaaccacaatgagtctcaagcaatctgagttgaagtaagttggtattaagcaggagtggtttggccatgagtataaaaatctagttgtgtcttaccagtggatgaggaggcaacagcctgtgctacctcatttgggagagggtgagcaatacctcattctgaaaggtgacatgtattccatcaatggaaatcactgagttcatactccaccattagtggctttaccattggtcttcctcaaggctgtcagagaactagtaacttgtatggaaaggagtatgcaggtatagacagaagaagggtttgaaaaagggagtcggaggatattaaaaacaaatcttatcagtcacattttcatgtaggcctgccttgcaggaaccagttacaaaaattaaaaaaaaa

SEQ ID NO: 411240 - DNA, 414 bp, Homo sapiens
taatgcctgtgtgagaatttccagaagcctcaatcctgctgtcatcctcattaaagaatcacctggagagaagatgcctttggagaactttaatccccttctttcttcacttaccacctcatataaagctaggattgacagtcaattttactctatttctgaggcctcgtaatatgtgaagtgaaggatattgggaaaggggaactgtcactgttctttctcatctgtccccaacactaggccctggaatgtggctaccccattctttgggggaaggtagcaatttccagtaattgggagtatctcagaggaatctaaaagaattgtggtaaagctagaagagttgacaagctaatataaaccactagccagttcagaacataattaaaatacctatgtatttgtttaaaaaaa

SEQ ID NO: 411241 - DNA, 3510 bp, Homo sapiens
tatagccacatttttttattcatagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411242 - DNA, 519 bp, Homo sapiens
  misc_feature (32)..(32): n is a, c, g, or t
  misc_feature (61)..(61): n is a, c, g, or t
atttggttcccaagggaacttttcttttattnagggatggggaggatgttttcttttttcngggttcttttctagggacttaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411243 - DNA, 681 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccactgcacagtgatgctcaaacttgacaactgccataatatctcggccaccgacgagacgattacagtttcatcagacaagggagcacagtatgactcccactggatctggcacaccgtagtggcgacagttcccagtgcctccagaaccgttgcgacaccccacgagcgacagctccctcgaccaca

SEQ ID NO: 411244 - DNA, 436 bp, Homo sapiens
aagaggagagatttttctcgttaagtatcctcccatttttagtctatcatccactgtctttgttttagtctagaatcttttgtcatttctattattaaaaaatcttccctcttaaagttctttctctctttctctctgctatttgaacatgttgactaccttttccttttccaagttttctccctgttggcttctgtggcaccacgttctcctggttctgctcgtagctctctgactaagctttccccttcacctactgaccctcgatgctgtgcacagagttagtctacttccactggactcaaagactggaactactccagaccagaaaataacaaatcaggtaaagtgtgaatttgatttaaaatgctctgtatgtcttgtcacttttaaagtcattctcagatttgttagtagactggaaataattttccca

SEQ ID NO: 411245 - DNA, 4484 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411246 - DNA, 4316 bp, Homo sapiens
aaggtctgctcccatcaggctccagactagtgggggatggttatagaactggccatatgtcagagatggctgcctgcgaaagagtctatgccaaagagtctatgggccacaccagcaatctcccgaataatcctcttctctgaagctgcccgtcttcggaaacctgtgcaatgcttaggcacaagcagatcagagtctaagagcaaacgctgtgcttgagaaaacagcactgctggctctgaaaaaggtgaagccagagaaaactcctagttctgcttagttacctgatgggacgaagacgcatcttcgtcccatcagcatggaataatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411247 - DNA, 3335 bp, Homo sapiens
gcgcgaactcatcatcctgctgcgcgaattcatcatcctgctgcgcgaattcatcatcctgctcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411248 - DNA, 2032 bp, Homo sapiens
ggggctgacgcagcattgccaattctaaatccatcatttgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411249 - DNA, 2753 bp, Homo sapiens
ctcccaaagtactgggactataagccacttttttttaaccgagatcacccagtctttgcctttctttgcataatcaagccctatttactgttaaggctcagttcaagtagtgttaccacttttgggaaagttcacgtaatctgaatttttctgtgttcatcatagcactccttccacagtattagaatttttttaaaatttcctttatttttctttacactgtgagaacacctgaaggctgggaataccttttatgtttttatctcactgcctaaaatagtggcatataggaaatgctaagatgtctgagaaagacgacaatgattgcttgctctccagcaaagttaataatcactataatctcatgatgatatttgcaatggcttctacatttttgcgttttgattttgtttttttttagtttcgcaagagggaagtcctgaaagaaatagatgtgaactatgttccttcgcctcctcctcccacgtagattgacttatacctggaacagctagcagtactaggtgtcattgggaactgatttcttttttcctgcttacaatatgaagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411250 - DNA, 2074 bp, Homo sapiens
ggggctgacgcagcattgccaattctaaatccatcatttgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaaaaaaaaaaaaaaaaaaaaaaaaaagaaaaaaaaaaaaaaaaa

SEQ ID NO: 411251 - DNA, 5054 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411252 - DNA, 4971 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411253 - DNA, 1786 bp, Homo sapiens
ggtcaggcactgaagcctggtcaggcactgaagcctggtcaggcactgaagcctggtcaggcactgaagcctggtcagccactgaagcctgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411254 - DNA, 4484 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaggattatcccgtatcgaaggcctttttggaccggtggtgtgtggtggcccttggtatgtgctttctcgtgttacatcggcatcacttg

SEQ ID NO: 411255 - DNA, 4608 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgagcgtaaattttttttaaacctttgggggtttggggccaaaaaatttaaaaaaacgttggggggaaaattttttcttccaccaaaaaattttttttttacatactatcatatttttccttccacccaacagcgggagaaaaggggcacccttttttggtgggacgaaccaaaggggggcacaaattttttctccccccaaaaaaaaaagtgtgggggcgacacatttttttcttttcatttttatttttccccaccccccccctccctttttttttttccctcccgccccacacaaaaaaaaagtccttgttgttggtggtgtggggcaccca

SEQ ID NO: 411256 - DNA, 3842 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgggcacatgcgttgggagcggcacatgcgttggagcggcacatgcgttgggagcggcacatgcgttgggagcggcacatgcgttg

SEQ ID NO: 411257 - DNA, 2421 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccggtgagtgctccctggtccgcccgcgtcccgggggagatccgtgcggacgggacgccggagcagagccactcgggccgcgtccctgtgggtcccgcgaccgttgtaagctacaaaccggaaagtgagccggcggatagcttcctcctctaagcgattagaaatggaagtgctgtgaccgctgattatttggtgaccgtgttgactttacagttaggacttgagctactcacgcatcgtgttagcatcagagatcagaaatccagaacagataatcatgccatatttgttctgtttttatttgaaagaattctcacatctcgaacaggatattttgttttgctttagttttggcatctgtacaactggcacggaatcattttcctttcaaatgtgttttagacgagtttaatttacctaactacactaaatgggctttaattttgtttctgtttggggagctattaaaactagctaactttgtacttatagtttacttcttgaacatggaattgtcagatggcactggaattctcagggaatagaacttttaaaagcattcagactgcataaatctgtttaattacatgctttggcaactggtacaaaaatgtttgataaaatacagaggagatgaatcatgttgcacgtaaatctgactacagcaaaatgtacttgtttcttattccactttgctagttgtaaaatcaggaatgtagcctttaaacttttgttggtgtttgctttcgagcatatttttgctttctcaatttagattttcttaatattttgttcaaatattagagttagggtagtttgttttgttttgttgtggaaagtgattcatatgccagtttgcctcctctaaagacagacaagatattggctaccatgatattaatgccttgttttgatgaatcgactggaaccttattgaacactctttattacagaactcgtaccctttattggaagtgtcatagacccttctgaaatatgatgacatatatggaataacttctgtttaaagatgcacagaggcaaatacactgcttgaagtccttggaccccagatttacaatctagctgtaaatcaatctcccagttttcagataagccttagatattagatacttcactcaaagtatggatcaagaaattgtattaatgtgctattggttcatttaattgttaaatactaaaatagtctataatgtaaaagcttgaaattttgaatgtacatgttcaagaccttttgggtgagatctgataaaactagtatctttcaggtttccacttagaaatgtgtttgagaagttgttttgtaacttttacttaagtcctttaaagcctccaatctgactctttatttaaatacagtcctaagtacagtattggcttactttaggtttcttaaaataggcttagcattacaaatacatttataatgttttattgtttaaattcaagtgcatattcaaaagaattttaaaaattaagaacaagagaagaatcacactatagtttaatgacatataggatttaagattgtataagagatcctatcaattagacagtaaataagtgcatcttttttgagacaaatgcagtaggcaaatgttgacattcaccagggcacagtcaatccctgacaatttcagaagttttgttgccaatactgatttatgtgggcagattctgtagtctgctgctccttctctcatggattaccttcttgttcctacagttgcacctattctacacaagagtggcattcatttgtatccaggaaagctagaacaagtagtcttttaatcttggctatattatcacagattcgacttaggatatgttgcatctgtatttttgttttaaataacaactcaagttccttctcagagttgggcatctatgtattttgtttattatgtacaaatgacctgaagacagcattttacccacttgataagttctcaaatagtctttgtttcttagtgccgtccatatcctgaataaagataccgtgttttctttccttaaaaaaaaact

SEQ ID NO: 411258 - DNA, 1345 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgggagaagatggcgcagtcttctcccatcaggaggggcataatgttagggtgtccaccttgggtgatgctaaattgaatcattg

SEQ ID NO: 411259 - DNA, 1356 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatttgagtgttacttcgagttaaaggtggaggtgggtctgtctccttgttagaggtcactgaggacatacttccaattctctgcaggggcgtcccggagacttgagaatataaagaagaaaacgcattggccacagtagtaagcacttcaatttgacgaaaacggcttgttaaagcataatttgggttttctacttcccatccgaagacactgaccactc

SEQ ID NO: 411260 - DNA, 676 bp, Homo sapiens
tagagatggggtcttgctatgttgcccacgctagtcttaaactcctagcctcaagcgatcctcctgctttagctctaacttcattttatataatatatattaataataattcttggtgaatgcaaaaagaaagaataagttgagtagaatagaactaaaaatattcattgaataagacatgagaaacaaatgtaatttgaaaagtataatatacaatttcagatataggaaattggaaagtattttaataaattatgtcacaaagcaattaataggaattattttttttaaagccagggatataagaattaactctcaggaagatgtatagagattacaggataatcatgtttctgtgtatatatatttgcataaaattctcatcttcctttaaagaagcttttaataacagtatttgaaagaggtttaaaactgacttctcttttcttttttaaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttga

SEQ ID NO: 411261 - DNA, 5089 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411262 - DNA, 5035 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggtctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411263 - DNA, 4582 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411264 - DNA, 2527 bp, Homo sapiens
aagaggagagatttttctcgttaagtatcctcccatttttagtctatcatccactgtctttgttttagtctagaatcttttgtcatttctattattaaaaaatcttccctcttaaagttctttctctctttctctctgctatttgaacatgttgactaccttttccttttccaagttttctccctgttggcttctgtggcaccacgttctcctggttctgctcgtagctctctgactaagctttccccttcacctactgaccctcgatgctgtgcacagagttagtctacttccactggactcaaagactggaactactccagaccagaaaataacaaatcagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411265 - DNA, 2959 bp, Homo sapiens
ctcccaaagtactgggactataagccacttttttttaaccgagatcacccagtctttgcctttctttgcataatcaagccctatttactgttaaggctcagttcaagtagtgttaccacttttgggaaagttcacgtaatctgaatttttctgtgttcatcatagcactccttccacagtattagaatttttttaaaatttcctttatttttctttacactgtgagaacacctgaaggctgggaataccttttatgtttttatctcactgcctaaaatagtggcatataggaaatgctaagatgtctgagaaagacgacaatgattgcttgctctccagcaaagttaataatcactataatctcatgatgatatttgcaatggcttctacatttttgcgttttgattttgtttttttttagtttcgcaagagggaagtcctgaaagaaatagatgtgaactatgttccttcgcctcctcctcccacgtagattgacttatacctggaacagctagcagtactaggtgtcattgggaactgatttcttttttcctgcttacaatatgaaggttttttggatccttttgtcttaaagagaaaaatatataggccccaaattctgccttttaaccccttaagtgatttggaagtattcactttaacattggttttaatcctacttttacttttttgaagtaccctatgatgagaggacctgatcctgctgctgctccatatagtactcagaaatcatctgttctacctctttatgaagtaagttctttcttacatctttgtgttccaaaataatttgtagaatttagaagtgtaattttgttatattgcattctagaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411266 - DNA, 5023 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411267 - DNA, 2058 bp, Homo sapiens
ggggctgacgcagcattgccaattctaaatccatcatttgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaaaaaaaaaagaaaaaaaaaaaaaaaaa

SEQ ID NO: 411268 - DNA, 5035 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 411269 - DNA, 4976 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcaatatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcacattaactttggaaacaaaaatgtacaattaagtaaagtcaacatatgcaaaatactgtacattgtgaacagaagtttaattcatagtaaa

SEQ ID NO: 411270 - DNA, 4082 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggtgggtaaaatctgtgtttcattcatttatttggaggtatatgttagaggagattttgtctgaatattaattatttacagaatgttcttttgattcactgtattcaataattttcacagagcttttaaattagctttcctgttgatcaagtttgtgtcaattaagatatatttgtaatggcatttctgcaaatttcatactctaatgtgaaataattacaattctctgtgttcagtatggtgaaaaagatatgtgaaggactcaaaataaacatgacgtactctttgga

SEQ ID NO: 411271 - DNA, 3962 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgttacaacagctcttcaaagtcattgccttcatcagctaataaagagtcagtattcctgtgagaaagtaccgttctctttaaatataaccaccctaattccctccatataaaaggctaatgaattagtttctctgtctctcgactgcatcccatctccatgagaaaaacatattcagaattaagacaacaaatgagctagctgta

SEQ ID NO: 411272 - DNA, 1471 bp, Homo sapiens
cgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgaactcgtaccctttattggaagtgtcatagacccttctgaaatatgatgacatatatggaataacttctgtttaaagatgcacagaggcaaatacactgcttgaagtccttggaccccagatttacaatctagctgtaaatcaatctcccagttttcagataagccttagatattagatacttcactcaaagtatggatcaagaaattgtattaatgtgctattggttcatttaattgttaaatactaaaatagtctataatgtaaaagcttgaaattttgaatgtacatgttcaagaccttttgggtgagatctgataaaactagtatctttcaggtttccacttagaaatgtgtttgagaagttgttttgtaacttttacttaagtcctttaaagcctccaatctgactctttatttaaatacagtcctaagtacagtattggcttactttaggtttcttaaaataggcttagcattacaaatacatttataatgttttattgtttaaattcaagtgcatattcaaaagaattttaaaaattaagaacaagagaagaatcacactatagtttaatgacatataggatttaagattgtataagagatcctatcaattagacagtaaataagtgcatcttttttgagacaaatgcagtaggcaaatgttgacattcaccagggcacagtcaatccctgacaatttcagaagttttgttgccaatactgatttatgtgggcagattctgtagtctgctgctccttctctcatggattaccttcttgttcctacagttgcacctattctacacaagagtggcattcatttgtatccaggaaagctagaacaagtagtcttttaatcttggctatattatcacagattcgacttaggatatgttgcatctgtatttttgttttaaataacaactcaagttccttctcagagttgggcatctatgtattttgtttattatgtacaaatgacctgaagacagcattttacccacttgataagttctcaaatagtctttgtttcttagtgccgtccatatcctgaataaagataccgtgttttctttccttaaaaaaaaact

SEQ ID NO: 411273 - DNA, 500 bp, Homo sapiens
catgtgggagttatttatatcctactgctcaaggtcatcatcaaggtctgattgcaaaaatttaaaaaattccaacctcaggcatgaatgggttaagacactattttttttaaatccatcttttacttctctgccttattctgccaactacttattgttatcagagaccccatcctttagtatcccctttttaactctcaaattctgagagtgttcgttttgtctgtgttctgtagcacccatttgttccctgttttaatatttattacactgctttgtaattacttgttagtgaatagactataattttggttagtactatttctgccttgtttattgttatctgaaagagcctggcatgtatgtattgtttgtatgctttcaacttactgttgaatgtgtgtatttaatagaattctataggaattcggcctagatctcatgtataatactttcaggtaataaaggatatattcttgagttggaaaatgaaactgact

SEQ ID NO: 411274 - DNA, 824 bp, Homo sapiens
gagagatttcatctacgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggaggtgatgctgaggtcctgagacctggcccggcaaaaccagagttgagcctcagcaaaacgtgtagccacttgaaattgatagagctttcctttgtgtttagttttatagttctctctgtatgtcattgttcctcttagttgagtttttgcctgtcaaagagatagagagctgcttttatgctgagatcctcaagccaaaacccacagtaaacgcaaagtaaaactttgaggctttgaacttttactca

SEQ ID NO: 411275 - DNA, 1187 bp, Homo sapiens
gagagatttcatctacgggaaaaagaccctctgaaaagaagtgtgaaatcatcaaaagagccattggaggggacaccagagagtcgtgtggctgaggtttcacatgatcccgccatgcttccagtccagaggagaaagctagacccactcctcaaaaagtataggcatcataagaaggccacaaggacaaaaagaaggaggaaggagaaaatggaggcccagtgctcccctgttcctccaacaccttcaacaccaccacaaagtgaagaagatgaggctgtagacaaaaagccaactctactcagtgcccaggaagatactcctgaccttctccatgaggacagattacagtatctgcaggaagagggttccggtgtgatgcatcaggaatgtcagatccagtcctgtgagctctcggtggctcagaagcccaggccctcttctcctgcagtgacatccttggcatcaccaccactctgctttggcagtttcctaagctgtgtctgccagaccttctcaaggtctaggaagcagaagcctcccagaagaaagggtaacaaccaggctgaggcaggagagagatgaacccggtacctcagatggaaatgcagaaatcaccgtcttctgcgtcgctcacgctgggagctgcagacgggagctgttcctattcggccatcttggctcctcccataggacacctttctaaagtcagtcatgctttgatacttttagttgtctaaaaagtggttgatttctcattttaaacagtattgagttttcttgagctaattgaccgtgataaatgggttttattacataaaatttcaaattatccaaactatatctatatttacatacatattttctccatttaatacaagaagcacactcccaggtgaggcatcatgtatgaaagtcctgagtcatcgagcctgttattaaaagctcaccagaatgcaggtattcgtgtggtattatactttattattggtattacttatcataataagtgttccggtaggtttccatcatagaaaactataggggagctctagttgcattttttgccctttaatatggtttttcctaaagttttggccactcggcccggtccactaggagagcttagccgtcgattggcggtggccgcccaccaaggggtcccgcgaggggtcttcccgggccgg

SEQ ID NO: 411276 - DNA, 678 bp, Homo sapiens
  misc_feature (603)..(603): n is a, c, g, or t
tttaagcccgttggaaaagcgcagtattcaggtgggagtgaccctattttccaggtgccgtctgtcacccctttctttgactcggaaagggaactccctgaccccttgcgcttcccaagtgaggcaatgctcgccctgcttcggcccgcgcacgtgcgcgcacccactgacctgtgcccactgtctggcactccctagagagatgaacccggtacctcagatggaaatgcagaaatcaccgtcttctgcgtcgctcacgctgggagctgcagacgggagctgttcctattcggccatcttggctcctcccataggacacctttctaaagtcagtcatgctttgatacttttagttgtctaaaaagtggttgatttctcattttaaacagtattgagttttcttgagctaattgaccgtgataaatgggttttattacataaaatttcaaattatccaaactatatctatatttacatacatattttctccatttaatacaagaagcacactcccaggtgaggcatcatgtatgaaagtcctgagtcatcgagcctgttattaaaagctcaccagaagcagggtttcgggtgggaattatactnattattgtattacctataataaaaagggttcaagttagtttttctttcattaaaaaaatattaatgggagcttat

SEQ ID NO: 411277 - DNA, 407 bp, Homo sapiens
ggtattaccttattggggagtttagaaggagccaggccattatgtgttctccctctttctcggttcattctccaacagtcctgaaaaagtgtctctacagactgaaatcttcccttagaggttcattttgcatcctaggcttggacaaaaggcattaggaaaaaattggccacacacttaagcttccctggaaggatattgttcataggtctacttttttcaattgactccagactcaaaggttagagaaagaagataaattactgcccacagaagctcacagcattgcttttgtcttccggacacctctcatgaacaccaatagtaaaaaccatctttactgtcactatctcactccaagcctgcatcacggctcaataacattattaaaatggctagactgcaaa

SEQ ID NO: 411278 - DNA, 474 bp, Homo sapiens
aggaaactcactaagctttataaggcccccatccctccaagtattatcctttccggctgccccaacattaatgacagcaactggtactagccatctgacatacaatcccagtacatttttgggctctgatgttttctaggaattttttctttacagacttattgaaattaagctctattccctcaagacctggttttcataaactgtatagttttgcagttgaggggaaatggtcttaggtcagtcaatccactgttgacacagaaatgaaatgaggtaacggtaggattattgttaagattgagagatgtatgaatcatcctatgctctttcccagcccccaggtgaccatataattaaaatatccttgatatttctatgtagtttaagtttttaattctagaacccctcaatctttctctattcaacttaaatgaaaagacatttgagtatccagaagacactcagcactca

SEQ ID NO: 411279 - DNA, 341 bp, Homo sapiens
tctcctgcctcagcctctcgagtagctgggactacaccacctgccaccacgcctggctaattttttgtatttttagtagagacggggtttcaccatgttggccaggatgatctcgatctcttgactgcgtaatccacccaccgcggccccccaacaagtgctgggattacaagcgtgagccaccacacccagcctattcaacttctttatgaaagaaagaacttcttgtggaatacatgccagagggtgttggctgcctttaatcagacatcttgaacatcaactaacagcattgcatttacttggttgatagtgatagggatggcatgaagtcttttcct

SEQ ID NO: 411280 - DNA, 424 bp, Homo sapiens
gtgcagtggtgcgatctcagctcactgcaatctctgcctcctaggttcaagcaattctcccacctcagcctccagagtagctgtgattacagatgtgcaccaccatgcccagctaatttttgtatttttagtagagatggggtttcaccatgttggccagcctggtctcaacctcctggcttcaagtgatccatctacttcagcctcccaaagtcctgggattacaggcgtgagccaccacactcagcctgataaagcaacactaaaaacagtttagtagtatctactaaggctgaatctatgccaatctatgaaacagcaattccactccgatgtgtaaatccaacagaaagaggatgtatatttaccaaaaagcatataaaagaatgttaatagtggcaaaatgtataatagtgtcaaactg

SEQ ID NO: 411281 - DNA, 292 bp, Homo sapiens
ggtggagttattaggtgaaaaatcaaatcattagctttaaagcttggccaaaagctcatttcctgggcagtaagggaagcaatgagtttgggtaatgggaatgaatcaattatggtgtatcttttcctgtaggtaacaacattgagctttcattcaacaagcaattattgggtccttgcttcatgcccagcactatgccaggcccaagggattcagaatgaacaaggttttttcttggccctcgaggtgttgctctttgtcaaatgagggtggcaggtatgctgataaatag

SEQ ID NO: 411282 - DNA, 358 bp, Homo sapiens
tttgtagaaaatgaggctagaggataagtatgggtcagataatgaacaagcttaattacttgcaatgataaggagttcggactttatcctcaaggcaaaggagagccaactgaaatctataaaacagaggggtaatgtaatacaatttttgtataagcaaaataactctggtgataatggggagaagagaatggatcttagaaagagactggaggtggggaaaatagttcagaaacaaatcactaccacagtcatgcattgtcagcagttatggaagttccctttgcattttccacatttttaatgaaaagctgaaaaaaaaaaaagctcaaattgacgttaccctaaaaaaggaaag

SEQ ID NO: 411283 - DNA, 935 bp, Homo sapiens
gaaagaagcaactgggaattacttcacacagcaaatctaaggaagagactgttaatttggctttgccagttactccttctcaaggcccataattaaatgtgagtttctgggcactaatgcaaaagccagatttgctctgagcctgcggggcttataaattggttgcttttgcaaactgttattgttcctttaggtcaagaggggaagaattattgactttgttcagttgaattaaatgctccccttgtggtttgaaagaagaaatttgcctccctcaccctctaagattacatacaaagggagaattgtttttgggcaagttagacttgatgaaaaaatatacagttctactggattatagcactgtgtgttgccttagagtcacatgactccagttttgccttctatatgaagcccaaggctttcatctttttctgatacagtgggctcttcagctttaagcactgacttttgtgtgctagtatacaatgcctgtacactcccacaaaaagctcaagatgtccttacacgtatttgctgtaggtgtccttcagccgatttcagtgcctagaatctagatgctttgcacctagtttcacctttgctcacagatgctagtgccttttagaatcccaagaggccaaagtaaaactgaaaagcctaggaggacctggtgtggcaaaatctcatcatgatccatgcaacagtggaggcaatgttacgctctgcctcaggttatacttctatgcaaattaaaaataaaattcataggaagcaattatattagagttggtatttaatccagcattcttctgaattatcttacatataaacttagttcatcttaatatgagaattatataataaatttgaggaaatcttacagatttgttcaaaatatgcttgctgaataaataaattaatagtatatgcta

SEQ ID NO: 411284 - DNA, 472 bp, Homo sapiens
cacgcctgtaatcccagcactttgggaggatgaggcaggaggatggcttgaggccaacctggtcaacatagtgagactctgtctttacaaaacaaataaaatattagctgggtgtgctggcacgagcctgtagtcccagctactcagaaggctgaggtgggaggatcacttgggctaggaggtagaggctgcagtgagctatgatcgtgtcattgcactccagcctgggcaacagagcaaagaccctgtctctaaaaaataaataataaatgtctatggactgcacaatattgttgattcctcaactcctctcttgctcttttgcatattggcaacataaaaagtgtcattttcgggctgggcacagtggctcatgcctgtcatcccagcactttgggaggctgaggcgggtagatcacttgaggtcaggagttggagaccagcctggccaacatggtgaagccccgtctct

SEQ ID NO: 411285 - DNA, 360 bp, Homo sapiens
tttcaggtaagaagtagttgagattgacactgttagaaaatttctcaatttctaaatttagaaattactagaaaaggaaaggatgtgtcattcaccttactccaaattgcgaaagtgtgttttttcctaatattcgtgttaaattttaccttaaaatttttatgatagtttttcttcatgagaaactgatatatagatgtcacgcaaatacaagcaaagttactgaattaaagtagtgggtacttagcattttttgtttatatattacatagtaaaatagctaaaaatcatatcccagaaaactcaaaaactcagtcagcactacactgcctggtggtttctgcttagtacactaaatag

SEQ ID NO: 411286 - DNA, 398 bp, Homo sapiens
cagtgtcctgtgaggtcctcagccggtggtttgtgaaacaggaatgaaatcaataggatgttgaggtctcaggtgacttgacatatttctgctttttctttttattaattatttatttatgtttgcttcacagcatttgaaaggaatatttctacttttaatttacaataaacaatcattttttcatttgtgttctatttttgtaagtctctaacatttttctcattctttagagtcctaaactctaatgaatcagggaaatctactttgacttgaggtagagtaggaagaatgatgtgtaaacaccaaagaacgtctctgctttgcttgagatgagtaacttcagaattgcatcctgtgcctacagtcagatttcttctgaactgttgaatgtagtt

SEQ ID NO: 411287 - DNA, 1340 bp, Homo sapiens
cttactttttctcagcagtattcaatatagtttaacattcccttcttttacttgaattctggagtacaccactgtctggttttctttatctttttgtttctattcagtatcttttgcagactcttcttccgttactcaaggtttacatgttggcagtttgtgattctcagtttggaccttctttttttctctcctgtctctgtctggatcagtgctcctcaaaatgtagtatgagggtcagttgcatcagaatcaaccctgtacttattttaaaaagcagattttttggacctctcccccggcatactgaatcagaatctctggaggtggtgttcagatccacatcttcattaagtaagttggcattatatgtacaccaaatttgaaaatcactaagctgtgtgatttaatttattcccttggtgtctatatccttagtattctttagtttatatttctagcattaacctatttcctgtctccagttttgtttgtccaccttgacatttctgcttgcttaactaaatggacatctctaaattataaatgtccaaaacagaactattgactgttgtttttttctctgcttgttctttccctgtcctatcagtaaaaagtggtactactatttaccctgttgcctaagtcagaaaccagtgagtcattttccttctctttcaatatcttatttctaaataaacctatcatttgtatccacaagaatatcccttagccgactcttgatccattgctgcctagattaccattctttctagcctaggctattgcagtagcttcctgactggtttccccactttcctcttttaccatctttctcctgatacatttccacccagcagctgtgatcttcttttcaaaatgtaaatcaattaatatcaacctcccagcttcctgttatatccaaagaaaacccaaactcctcaaccaggccagcaaggccacctggcatgataatggcctcttacccgtgtatcacactacctctgttatagccacactagctgcttttgttgttaaataggctagtttcttctgcttcaagggttttcagctcattctcactctctggtatatgcatcccaaggccggctccttatcctctgggttcggtgttgcctcctcagaatagcagcctttcctgtcccctaattaggttttaattagttttttgttttatttttatttttttttaaccactgtcccctattcaatgctttctttagtgttaggacacaatttgtaattgtttgtttaatttattgtctgtacctccactggttttgagaagatgaaataaaatgactgttattcaccagtgt

SEQ ID NO: 411288 - DNA, 715 bp, Homo sapiens
tcttatttgatatgaccatttattatttacaattttttcatatttataacattataaacacttttaaagctataaacattttccttccatttttctgttgtaactattaaaaagcaatacataatagttgctgtgcgtagctttttcttggtacttttgacttacatccagcatcaaataaaaatatatacattaatattaataagatccacttaatttggtttacccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccc

SEQ ID NO: 411289 - DNA, 601 bp, Homo sapiens
  misc_feature (31)..(31): n is a, c, g, or t
  misc_feature (601)..(601): n is a, c, g, or t
gagtacggcaaatatggcggagccatctgtngaatcttcaagtccaggaggttcagcaacatcagatgaccatgaatttgatccatcagctgacatgctggttcatgattttgatgatgaacgaaaccatttaaaacaaaaaaaacaaaaaaaaaaaacaaaacaacaggtgcgtggggcgcgcgccgcgggcccccccggaaagaggtttttgagaacaccccacggcggggggcggccgcggggccccgcgagacaggagaatagagaggacaaacgggggccaaaaaagcgggtgtctcaccaagaggaaaaacacgcgggcgccgagagagaaagagggggcgagggagactctctccaccacaaatatatataaaaagacgccgcgcgggggcgaaaaaacgagaaggacgcgatttcgggagaacaaaaaacctcccacgcaagagggcgagccgactcgcggagaggaggatacaaaacaaggggggggagcactctataataacaaaggggagagaccacaccaagagaaggagaaaagcccaacacaaatacataaacgatgaaacgacccccagcacacgcgggggggaan

SEQ ID NO: 411290 - DNA, 493 bp, Homo sapiens
taaacaatttatcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatgtaggtattatgcttctgggcttttaaaaaaaaa

SEQ ID NO: 411291 - DNA, 356 bp, Homo sapiens
ctagaggatcccgacatcgtcaagataaatccaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaggctatccagatggataatcctatctgtaatcacacagagcaatgattatgg

SEQ ID NO: 411292 - DNA, 394 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggaggtaagggagcgagctccccctccctgtcccggagccgggcgcccccggccctgggccggggaggagtggagtgggcctggccaggagaggcccggccctgctggcgccgctgcccacctgttgtccggaacaggccattctctgggcgggagcttcgcctggaacttagttgggatgggtccgggggtaggaggaagcggaggcgtacttggacttcgggggcagtttgaagggtagtgcagcgt

SEQ ID NO: 411293 - DNA, 283 bp, Homo sapiens
ttgaatatttaagttctctttgatagcataataaccttgaataatgagaaaagataaagccggtatcaacctgtatattaatattctacagaaatatttgtttttctctccaagaaaaagagaagaaaaaggcataccaattgtttgaggttcagatagtgtttccgtttaaaatatacagtggaccagagatcactgtgctgatcagtagtaagagccagagaattattttgatttcttctttgattaaatggtctttttaagtaaaagagttccaagaaga

SEQ ID NO: 411294 - DNA, 5073 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattc

SEQ ID NO: 411295 - DNA, 5158 bp, Homo sapiens
aagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattc

SEQ ID NO: 411296 - DNA, 5150 bp, Homo sapiens
tcttatttgatatgaccatttattatttacaattttttcatatttataacattataaacacttttaaagctataaacattttccttccatttttctgttgtaactattaaaaagcaatacataatagttgctgtgcgtagctttttcttggtacttttgacttacatccagcatcaaataaaaatatatacattaatattaataagatccacttaatttggtttacccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattc

SEQ ID NO: 411297 - DNA, 4443 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacata

SEQ ID NO: 411298 - DNA, 4676 bp, Homo sapiens
aagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaaggattttttggacctctcccccggcatactgaatcagaatctctggaggtggtgttcagatccacatcttcattaagaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacata

SEQ ID NO: 411299 - DNA, 1067 bp, Homo sapiens
tactactactaaattcgcggccgcgtcgacccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacata

SEQ ID NO: 411300 - DNA, 1192 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagtgacgggttttggtaattcaactactattacttgaaagtagtagatttcataggatactgttataaaatctttttaacctcttttctgatttcaggagtaattagtaattgtggttaaatggaactttcaatgaatagggtgttaaaggaagcaatacaataataatatatctaatctattaggaggaggaggaggaggcttggg

SEQ ID NO: 411301 - DNA, 1015 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggtagttagaacaatattttcccaaaatttagataaattaatatttttttaaaaagcctcgtgtaattatttttttttttactaactatgtatattgataaaatcgatgtaagcccttttatgacatttaaatgtttggtaaatgttcagattccttcttaacacatctaggttagattagaaatctacatttctggcggggtgtggtggctcacgcctgttatcccagcacttgggaggctgaggcaggcggatcgcttgagcccaggagttcgagaccagcctgggcagcgttgcgggaccctgtctcattttataaaacaaaacaaaaaataa

SEQ ID NO: 411302 - DNA, 774 bp, Homo sapiens
atgaatgttaagtgaatattaggatatatttgttaagaaagccttctgaatttaacctcaactaatttttaattttcagctctttttaatataaaaattgttttattaattttaagggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggtaagcaaccagagaaacatttctctttcttcataataagggacactttcttgcagtgacttgggaaattccgtttgggtttctattaaacttccagagcagaaagtaaaaaatgataacacatgagacaaacataacatcagcatacatatatactaacagaatacaaagtgattggacatcactaaaaagtaattttaataaagcctactgtcaacagtgactatttcttgtaagaaatttgttctttttcagtagcatctcttttcctgtcttgtctagttgggttgatgcctagatacaagtatttatgttaactcttaggtcaaaaccctgcagtttcacatgagatatacagatcattgcaaaataccttgatgtaaggtaacaagtgcactgttttgaatatttaagttctctttgatagcataataaccttgaataatgagaaaagataaagccggtatcaacctgtatattaatattctacagaaatatttgtttttctctccaagaaa

SEQ ID NO: 411303 - DNA, 492 bp, Homo sapiens
cgttgcatttcacctcagtattattactaatattttcatccagtcattatttgtcattcatcttcacaaaggtacctctgaggtagttaattggttgtttttgtattttatgacagagaaaccaggaacagtttactaagatggtaaggctagaaaatggatataaaatctgttactagatcttactaatgttttatgttatttttaaaataggagattatggtgggctccatgtttcaagcagaaattccagttggcatttgtagatacaaagaaaatgaaaaaggtgggttattagtaaagttacgtagctgaatttatgctttcagtgtaatgaactgttactttatatgtaaaatgtgataagaacatgacagcctactaagtaaccccattgtaaccccattggtttgtgaaagaggacccttcattatttctgtgagaagaatgtgtgtactcaattttttcagtttggtctatagaagcctagcc

SEQ ID NO: 411304 - DNA, 797 bp, Homo sapiens
aagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggtaaataacatgtagagctagggtatgaattggttatgacttttttgtggaaagggaagatctgaaattttgattctctgattaggagagaaattgtgttatatattaatgactgaaaaattttgtgtgatcataggtgggatatttaaagtttgaaatgaaaggatttaaaaacaataactttattatgtgcaataacagaattcacatagttactttggtaaaacatagactgttaaatgattctgctataaaggtctggtcaaaaatggactataaaaggattctacacggcctcatatatcctttgtccttccc

SEQ ID NO: 411305 - DNA, 524 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagatgcgattttctacgattttttaggtcaggtggattaacct

SEQ ID NO: 411306 - DNA, 5232 bp, Homo sapiens
aagaaggaggcgggcggcccgggcctcaggcccctcccaggctctgagtctcccggctgcaggcggatggatggggcttcttcaggcggtggcggcagcagcgaaggtggcggcggcagcagcggcagcggctatggtgtggtcgctcgattctcccagtgcctggctgagtttcggacgtggttaagaaccaactggttgaggttcaatgcagacaagacggatgtgatgctgaaaatgtgcatcagatgtttatgtttaattggtttacagactgtctgtggactcttttcctgtcaaattaccagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattc

SEQ ID NO: 411307 - DNA, 5420 bp, Homo sapiens
  misc_feature (468)..(468): n is a, c, g, or t
taaacaatttatcttctatattcttcagttacttgtagatagtttcatgtatagtgaattggggaagagttagaggaactttcgtgatctgtgtcctacaaaaaaatctaagacaggtgaagaagtgaaaagtacaattgatttatagttttcctggcctcaatacttgaataattatgacgatttttgagaccagtggttttaaacaattagacaaaggagaaatgcttggttggcttttactttgagctctcagtagattcattctttatgaagccaatataaaagcatgtgattaaataatccagatgctgaattattgtgcttttgatcaaataaatctgaggatttaaggatagcttgtgaagtaacagtaagtgcaaagcaacagtatatatctatttgttaaatctgagggggaaaacaggttattgaagaagtatgtctccagagaaaaatccatctgtngaatcttcaagtccagaaatggatgaaaggtttgactgcccatgaaagtacaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtcacaatattttctttgctatcgatggataattaggagtgggcacttggaataactgagggctggtgaatataataggcaatatttacatggggtgtgtaactaaataccaaatcagatagtaaggttttcccaactataatccatattcatgaaaaatgccagtgtggaaaaccatgtaacatacagaagaacaggagtttccaaattttaaccttttattctaaaaatgactctcttctctcaaaatgactttttctgtatcacataattc

SEQ ID NO: 411308 - DNA, 4802 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgattttgatgaaaaaagtgagagacctgccaaaaggcgaagggtaaacagcaatggaaaagaaagtccaggttcttctgaatttttccaagaagcagtctcacatgggaaatttgaagaacttgaaaacacagatgactaaattttagacctattttactttctttggagtaaattctggtgtgactaaaattttcagggttgatgggttaccttaaaaagttgatttccttgaagcagtttgaaaatttgaattgagtcttaactttaggaaatgaggtttcataattctgccttttgcagatttttttactttaaagctgtcagactcttttaagggtattttaaaaattagtaaatttgaatgaactaaagatatatctctaccttctcatttgaatatctttagttcattcagatttactaattttggtaaatctgaatgaactaaagatgtatctgtaccttctcatttgatgtattaatcataaaatttcactacaaggtaatttttgcttagtttgatggatgaatgggaaactcaagtccaaatttctgcttaataccaatttctctgagtttcttgaaatgtctttaaaacagacatttttctcaccaaacagtttgagtatctttattaaggaaacccttacgaatcctgaaaattatgctagcatgatttttttatatatagaagtttaaaaataaaccaggtcaggtttgtatatgtaaaattgttgacatcaatgatgtctttccatattcttatctgggcttaagaaatacattctgtatttttccagattctttgtagcctttgaaagatttttacagtacatatgtcttgactgagctgtcctttcttaatacaaaagcgtgtataattttcttaacttgtacagttggtaaacttttatgagaggaattgttattctgagtctgtcagctttcattttattttgctaaggtttttctaatgaatttttaagtgtttgtgtagtaattaagtcatatttcttatccaggtggttaaagcattcataaaggattataaaatttttttttttttttttttttaaatttctacttaagggcaagtaatttgagaattctgaaattaagcatgatgcttagattgcagtttgttttgcatttgctataattttcaaaattatttttgaagcaagacaaaagtttaatgtcagcttaagtgcttaaatatatcatgctgaccagaatcctgttatttttatatgcatcataaaatttcccatttctgcattaaataaacagaggaggggggtcaagtgatacttagatattggcacacacaaggaacaactgttggcaggcagtatcgattttatgaagagaaagtgaagtttgaaaacttttcaaacttttctagttacaatccaatttttcagatttgataatgcttttccaaagtgaaaataagatacacaataatcattgctctgtgtgattacagataggattatccatctgcatagccttgtaaaagtgccattttatttttagtgctaaattcttgttaaataatgtagttttatatagctgatagaccaacctatatccaaacttttataaaatattaattattcttgtttttctcacacaggcatactccaaatgcttcttccagttcatttttcagccatcagttcaagagccaatgcctttttaaaataaagcttctgtggtcttgtttttaatggctcaactgtctgatgtaattgagtgaaggtttgcactgagaaattagcattcaggccttacccccatgaagtattactgttaacatatgttcggactgcttcccttcaccaatgtgaacaactttttttcccaaacagtgttaaaagccactttgcaacacttgacttcatcttaatgtacattcactgttgttacatacatatctaagtaaatcaaagttttgggtggaagtgttgagaagtatgagttttttgttgtttttgttttacttaaaacttttaatttatccagaatggcagtagctttagcaagcagatggtcacaatctgttttctaaatcattttttattaaatgaatccaaagtatcctagctctttgtcaaagatggtctgtagaaatgtttttaaagattagggatgctgtactttttgaattgttgcagtgttggagatgccattttcacctttttaaaaagatgcattttatttgcaggtttgtgaagttcttgcaaactcttactacagaaatgttttaaatacattctcaggcatgtttgcaaaaatatggcacatgtatacattttaggaaatgttacttttgttaatctttaaaaaatacacctaatgaaagacattccactattatgcgtaatgctcagctttttgtaaagaaatatttaattgtattttgtgtttatacaggtatttcacacaataatttgttcttaatgcagccactataacttgataagtcattgcactatttaaaaagttttagtaatatcatgaatttaatttgcttaagatttagtacatttcagaacttttgaacttttgacaaattgcattgggaaaagaagtctgttaatagtgatttagtctccccgcctcattcccacccccaacaaagcactatcattttcatttggaatgggtattttctgtttcatgatgtattttcaaatagagttcaggatctgcaattcagttcaacacaagtttgttgagctttaaaatgtatttgaagtaatatttaaataggcatttaaaatttcaaattagatgttaaatttatgcatagtaattttgcactgtaaaataattcccttctcccattccttgtctgccattctgaatatgcttattaaaatatttttttaaacatatttgcctacataatactgtgtgaatattttcattagattaattcactaagattttattagagattgtttgaatgatgcatgttattgacaaggcaaatatatatatatacacagtctgtttcttctattcctagacatattgcactactttttcagtggttcttggtcccctttaccacatcttgggtgatgtatttttgtcttcttcccctttgccacaagagatcctttcagtccctagacctccattcactctgtttctcttctgctggattatataatttaaaaataatgtgttcccgtattttgtagtggagttcatatcacattatgttttgcaaaataaaacttgttttgtc

SEQ ID NO: 411309 - DNA, 1577 bp, Homo sapiens
gcgcgttcccgccgaggcagtggcggcgggagcggcagagacggcagcggccggagtcccgttgctgagtctcacatccgggttctggccgtgacccagctgcggccgccgcggagatgtgacccggcagtacggcaaatatggcggagccatctgttgaatcttcaagtccaggaggttcagcaacatcagatgaccatgaatttgatccatcagctgacatgctggttcatgattttgatgatgaacgaacattagaagaggaagaaatgatggaaggagaaacaaacttcagctctgaaatagaagatcttgcaagggaaggcgacatgccaattcatgaacttctcagcctttatggttatggtagtactgttcgactacctgaagaagatgaggaagaggaagaagaggaagaagaaggtgaagatgatgaagatgctgataatgatgacaacagtggctgtagtggggaaaataaagaggagaatataaaggattcatcaggtcaggaggatgaaactcagtcttccaatgatgatccatcacaatctgttgcttctcaagatgcccaggaaataatccgcccacgtcgatgtaaatattttgatacaaatagtgaagtagaagaagaatctgaagaagatgaagattatattccatcagaagactggaaaaaggagattatggtgggctccatgtttcaagcagaaattccagttggcatttgtagatacaaagaaaatgaaaaagtatatgaaaatgatgatcagctcctgtgggaccctgagtacttaccagaagataaagtgattatatttcttaaagatgcatctagaagaacaggtgatgagaagggtgtagaagcaattcctgaaggatctcacataaaagacaatgaacaggctttatatgaattggttaaatgcaattttgatacagaagaagcattgagaagattaagatttaatgtaaaagcagctagagaggaattatctgtttggacagaggaagagtgtagaaattttgaacaagggctgaaggcctatggaaaggattttcatttgattcaggctaataaagtccgaacaaggtcagttggtgaatgtgtagcattctattacatgtggaaaaaatctgaacgttatgatttctttgctcagcaaacacgatttggaaagaagaaatataatcttcatcctggtgtaacggattacatggatcgtcttctagacgaaagtgaaagtgctgcatctagtcgagcaccatcccctcccccaactgcatcaaacagtagtaacagccagtctgagaaagaagatggcactgtaagcactgctaatcaaaatggagtgtcatctaatggaccaggtgaaatattaaacaaagaggaagtaaaagttgaagggttacacattaatggaccaacaggtggaaataagaaaccacttcatgcagatatggatactaatggttatgaaacagataaccttaccactgacccaaaacttgcccatatgactgcaagaaatgaaaatgaaaaagtatatgaaaatgatgatcagctcctgtgggac

SEQ ID NO: 411310 - DNA, 480 bp, Homo sapiens
cgtactgtatatttaaaaatttactaagaggattgatctcatgtgctttttgccacaataaaaagtaatgtgaagtatgaaaaataataactggagagtttactaaatttgtgtaattaaaaataccaagattaattacatgctaatgttttgcttttttcagttttctcactttgttttctaaaaacatgcaatgttacagatacatctaagtcctcaacctgcagttttcctccctagaggtagccgccatcctaaagtcagtgtgaattattttcatgaatgtttttgtgcttttatgatgtatgtagcatccataaatgatactattttcaaattttacatttatgtaaattttaatcagcatcacattttttaaacaaaacatctttattaatgtagatttgggccattcattataaatcccacagaacaattatttgaataaactgtagtttatatattattcactaagtggat

SEQ ID NO: 411311 - DNA, 298 bp, Homo sapiens
gtgaaagcaactaggaacagcagaggcaagataaagaaattgaggagtagctccattccccctataaagccttaggtatctccacttcggtttttcttatcaaagagggtaggttgaaggaagaaacaagattgtacaataaaaagctacctaagttgtattctagtattttttttccgccacaccctccattattagcttattaattcaactttttagtcaacaaatagtacgtttcataaaaagttcgttcattatgagagcaataacaataaaggttgtattgtttcttacatcc

SEQ ID NO: 411312 - DNA, 290 bp, Homo sapiens
taaaattaataatacatggtgactacattgagtttttctgggggagtgctagggtggctcaatatttgaaagacaatgccatccaatatgttaacattctaaagaaacaccaccttatcatgccaatttatgtagaaaaatcattcatttgataaaattaaacagccattcatgataaaattctcaacaaactaggaatagaagggaatttactcaacctgatagaggatgtccacaaaaaacctacagctaacatgatggtggaggaatgaatgctttccttccaaagc

SEQ ID NO: 411313 - DNA, 514 bp, Homo sapiens
cacttggcttcacacctggcaaggggagtgtggttggatctcagccttgtctctccttttggaccaggcatctccatagagagaacaacctgaataattgcatttaaagggaagctgtggctgggctgtcctcttgtcccttttttctgtaacactcaaccatgcctgagctcttctggcagccccaaccatctgggtgatacacacacccagatgtctgtaaatctctgttgtagacccaactaattctaaagctgggactcagtgattaatataatgtgtgaacaatcgaaatatagaaacatgggaacaacaaaaatgaagagaaggaggatttgcagattatatgttgacatgttgaagaatgaataaagttaatggggaaaacttgtgagatctgagatgaaatttaaaaagaggaagaaatgcggtctaacagaatatatgtttcctggtacatacaaaagaacttaggaactatttcatttttctaatctttacagttccattttag

SEQ ID NO: 411314 - DNA, 229 bp, Homo sapiens
ctttattttaactttcaaatatttaaacatatggtatgcagacctcttgccctgtacccaccctcataataattaacccaatgccttaaagaccccacctcttaatactgtgacattggggattaagtttctaacacaggaaatttgggcaacacattcaaatcatagcaccaatattctccatagccttcttaatatgtactgtgagccatctttggacaagtttgag

SEQ ID NO: 411315 - DNA, 473 bp, Homo sapiens
tggaaccactgaagcagaaatttcatcaggcaataccccaggatcaacgggagtcaccagcagccaagaaggaaccactgtggtatcaagtggaatcactggaatcccagaaacttccatctcaggtccttccaaggaagcatctgacaaaaccactgctcctggacctcctaccacagtcactgcttccacaggagtcaaagaaacttctgaaactggagtgcaaacaggctccaccttggttacagctggagtgccaacaagaccacaagtatcccagccagaaaccactgtcgtggcaaccagagaagtagaaaccgaaaataaaacagaatgtctagcctcacttccaccagctccaggtaataattccacgacttcagaattgttccacattaatggttcctcttgtcaatcaaatttcagaggtcacgctaataaaagtcactagccatggaaatgttataaaatag

SEQ ID NO: 411316 - DNA, 460 bp, Homo sapiens
gtatgttttaatttgtcttgggtagatacctaggaatgaaagtgatgggtcgtagggtagttctatgtataactttttgagaaacggaaactttttccaaagtggctgcatcatttttcattcccaccagccatgtatgagggtttccagttctctgacttttttttttttaatattctagaaatgcactgtaatttgagattgatatttttttcttagcattttgctagcaacaagctaccatcttggagatcattaataattagtctttaattattaggaatggttcctgagtaaaatgaaaatatgtcagtctgccataaatgaaattcattattttagaatttcaaactttcttcttaaatgaagtgtggtaggaatcctattttaacaactgtaagctaaagaattagctgtgaatcttgcccagtttcaataataaatcagtgaattccaaaaa

SEQ ID NO: 411317 - DNA, 185 bp, Homo sapiens
cacaaatgttagccggtgaattcaccgttctttccgatggtaagttagtgtttccctcctaaaaggtggtaacagtgggcttgtccttggttcagtctgtttcttcttaggcccagtcagttacccactgaattaaccccacgctggaccctgacctctttttggtaccatgtacccttttggca

SEQ ID NO: 411318 - DNA, 417 bp, Homo sapiens
cgatatctagccacatcctgatcttgtaaataaagttttattggaacatagccatgcctgcttatgtacacattatctatggctgagtttacactataaagacagagttgggtaacagtgacagagacctcacggcccaaaaagcctaagctatttaccatctgtccctttccagaaatagtttgccaacaactgtattaaaagatcctctatgaaagcaaaattcaagaagaagggattatgtatgtccttagaagttttgaaaccagataaattgttcttttccactgtcaagctaattttttagctatgttaaaaaaaatcagaatcttagaagttttggggaatatactgatgaattcttaccatctaatactctttaaaaaacatatatccccaacacaaagaaagaacaaa

SEQ ID NO: 411319 - DNA, 1368 bp, Homo sapiens
ctgagatgccgtcgaggatgtaccgaatttgtttgtcaattcgttctgaagagccccccaagcctgggattatgaagaaggtaatactaccagtcatctgagttcttctgtgttctggctctccctgtgagcggctgttgtagaactgcctggccatcctcaaatttcgtgcagttacttcaaggcgtctccaggtggagtgtgtgactcctttttgccaccgcgtggcttctgccactttcttcacctgcttcagcccacttagaggaggttggctgctgccctgccctctcccaagtgaccccttgggaatcctcccagtgaggactttgctctctgtgccagaggtttgccttgtgctgccagtgctctccccattgccactgagtctcttcaccactgtttcactggggcacctgcatgggccccaggtctcctggagccctgaaattactgaagcccacttggttcagggcagaaagggggagaatactactcacctctttgttggggatgtcaaaggaggaccttgtggcatcttgcagagtttgtgtttatcgctccctctccctgtaagtcttgatttgaaatcaaaagaagctagaaggaaactacggacgcaggcacggctctaggctctgaatctgcttccgcgtcggcacccaagaatttcttattgggtcaagctggttcagaagccctcttccctcaggatggtgtctcttgcaggaggatccttggtctcatgcaaatgggctctagactaggttgtccctccagtctccagagacccagacagctctgagatggcttcaggctgaaaccagacccttgcacaacaccaaaacacttatttaccaaacatggtgttaccttcacaatcggtttctttgctttgctaagaagagatctcttcaagatcgataaaacagtgacctctgttgggcatttactcaagttttgtttcgtgcataacatttcaggacccgcctgttggggaaagtgaggtcatccattcttcaccgattgtctaaacagagagacggtggtcctctgccgcggtgggattctttggtgtgaaaatgaaaatgggggaggatggctggatggtttcatttttagtgctctcctgtcttaagcaacgtaggcactcctgaaccaagttctctttcctgcatgaaacgaagccactgctcccagctccgcagccgtgcactgtgatccgtctatgtaatgtgagcttgcttttactcaactatctattttttagaaaatacaattcaataaatttcaagtacttgaactgagtgacacaatacaacacacagatttatcttttcaataaaaagtgttttttaaatagaaaaa

SEQ ID NO: 411320 - DNA, 1537 bp, Homo sapiens
tagtgactcagcacttttgcatgtcttgacaaagagtaaagctgaagtcatgcacgaagttttacaaagagaaaaaaaataagctaaagctatgttttttgaaaaaaaaaaattttttttttcagtgaccagattaacaggctagaatttagcgttccagttaatttgtatttgtaaaaaccaaagatgttctgaactgagtttcctctgactccatcgcagccccccaagcctgggattatgaagaaggtaatactaccagtcatctgagttcttctgtgttctggctctccctgtgagcggctgttgtagaactgcctggccatcctcaaatttcgtgcagttacttcaaggcgtctccaggtggagtgtgtgactcctttttgccaccgcgtggcttctgccactttcttcacctgcttcagcccacttagaggaggttggctgctgccctgccctctcccaagtgaccccttgggaatcctcccagtgaggactttgctctctgtgccagaggtttgccttgtgctgccagtgctctccccattgccactgagtctcttcaccactgtttcactggggcacctgcatgggccccaggtctcctggagccctgaaattactgaagcccacttggttcagggcagaaagggggagaatactactcacctctttgttggggatgtcaaaggaggaccttgtggcatcttgcagagtttgtgtttatcgctccctctccctgtaagtcttgatttgaaatcaaaagaagctagaaggaaactacggacgcaggcacggctctaggctctgaatctgcttccgcgtcggcacccaagaatttcttattgggtcaagctggttcagaagccctcttccctcaggatggtgtctcttgcaggaggatccttggtctcatgcaaatgggctctagactaggttgtccctccagtctccagagacccagacagctctgagatggcttcaggctgaaaccagacccttgcacaacaccaaaacacttatttaccaaacatggtgttaccttcacaatcggtttctttgctttgctaagaagagatctcttcaagatcgataaaacagtgacctctgttgggcatttactcaagttttgtttcgtgcataacatttcaggacccgcctgttggggaaagtgaggtcatccattcttcaccgattgtctaaacagagagacggtggtcctctgccgcggtgggattctttggtgtgaaaatgaaaatgggggaggatggctggatggtttcatttttagtgctctcctgtcttaagcaacgtaggcactcctgaaccaagttctctttcctgcatgaaacgaagccactgctcccagctccgcagccgtgcactgtgatccgtctatgtaatgtgagcttgcttttactcaactatctattttttagaaaatacaattcaataaatttcaagtacttgaactgagtgacacaatacaacacacagatttatcttttcaataaaaagtgttttttaaatagaaaaa

SEQ ID NO: 411321 - DNA, 742 bp, Homo sapiens
acacacttggaaaacattttattaagtactgtataaacagctatttagataataattgcatagaactataccaaggtaattgtgtctttaaggaacaactaccaagtgaacaagatgagcaaagtcctctattatacaagatttccttcggtggaacattatggtgacaaagcagcgtaatgggctcttaagcagattgatttttatcaaactggacatatcagaattccttatgtataagagaaatatgcacatgctcctttcaagaaaagagtgataacccaccatggaattacctccagtttaaacatgtactcttgactgccaaaaatatcgagatatgttaagcaagataaagcagcagaacacgctttaaaatatgttgatctctttctgtaatctacatgttaatattaaatgttcttatccttggcattgtttcctcagaatcatccagggctcaaattcagatttaagtttaaaaaattctatctggaattgtctggtgatctctgacccaactactgaaacaaagcaaatctgcttcatagccagtcacattctgtatagaataaaacagttggtagttgtcatatcactgcacaaataggagattgccacagagaagtgtggcgatttgttctcctagccacagaatcaatttaaaaattgtagaaattggctgggtgtggtggcttacacctgtaatccaagcactgtgggaggctgaagtgggaggatc

SEQ ID NO: 411322 - DNA, 376 bp, Homo sapiens
gtgggagtataatgagaagaacagattttagagctgttagaataagggatatattgcttagtttttgtttgaatctagaatgtattttctcataacagttttgtaaaaggtggttaggaactcttgcacttaattccataattttaaattacacaattaacatatatgctcattgtgtaaaacctaggcaataaatgagcaaaaaatacctaaacattgcttatgatcccagagattaaatggatatctaaggaaatttttaatttgtgtatgtttattttaatataaacatggaatcactgttttgtagcttgctttttttcttacagtaaattgtgaactgcttatgttaataaatatatttctacaacattaa

SEQ ID NO: 411323 - DNA, 301 bp, Homo sapiens
gtaatcctttggaagaggaggcagtatggctgacaccttaactgtagctttgtgagatctgtaacagaagactcagtagctatgcctggattcttgatctgcaggcattctggatatatgtgtgaacatctttatccagaactgaattagtgctttattttgattatgatctactttgctgatacttgaagaagaaacaggacccaaagctaaccacacaatccctaaatacacttagaactcatatagttaatatgttatgttttatttctcctattcccattttgttcattatataccc

SEQ ID NO: 411324 - DNA, 659 bp, Homo sapiens
taacactattaaaccgtacacttaaaaatggttaagaaggtacattttatataatatgttctttcttatcacagtttaaaaagcaaaacacaacaaaaaagctccggccaaagaaaggaaaatttgaggcttgaatgaggtatagtgaaagatatatagagtcagtgttagaagtatatcatggtcccatataatgaatatcattacaccttgaatattcaccaacaccatttttacttcatagactcaataaatagactcaaataatagaacatttaatacctcatgtcagataagtataaaaatcctgcaacaaaacaccaagaaatactggttgaaacatgtttataaaaactctcaaaatataaaagcgaatgcttatacactgttgatgggaatgtaaattagtacaacctctatggaaaacagtatggagatttctcaaagaactaaaagtagaattaccatttgatgcacgaatcccactactgagtacccaaaggaaaataaatcattatattgaaaagacacccacacttgtatgttaccacagtaaagttcacaataacaacgtcatggaatcgatctaagtgtctatcaagagatgactggataaagaaaatgtggtatataaacaccatggaatatattgcagccat

SEQ ID NO: 411325 - DNA, 255 bp, Homo sapiens
agttttcttcagtgaaacatgattgcagtgacacatgtcacctctacgtttggcccatacaaacctcacacttatcccaatatgttctttctttctactggttgattggtgtggcaaagctttgtataacttctagatgccacatattgaggatggcagagctatccccaaatggctctatagggaccactaagtgactgtggaggagagctgacatcaatccaaatcctattataaaaactttttgtttttaag

SEQ ID NO: 411326 - DNA, 748 bp, Homo sapiens
gacatttctaaatatttctgtcccagcaaagaggtttttgtagccaaggtatttgctcataagcatctatagttggatgatgtcacatacttgctcatctgccattacttgggaacagtagcttgtggcaagcaagaacctgaagcttttacatggccatggttatgaaccaggaaatagggaattaaataaaatcagaaaaacggttgttggatctaagttaggaatcagtacaagacctcatagaatgataggatgactcatggttctgtgcctcctagaacaatgttcaatatgactaacctgccaccaaattaaatgtttgctccaggatggtcagtaagacaggcttggattttctaatggacattttagtaagcaggtctgaggcaaggtagagagattcaggaatactgggccatcagggattataaaggtttgaggggataggagggtaggaatagaagaaagattctgtaaatctttcttcttcacatttgcaagtctttttactctctattatgcctaggaatgtgtgctagtgccaagcaaatcagagtaaattcctctctaaaagagccatccagttaattagattgcaatacatagatgatatatatcatttagcattcttagaggttataaattaagacattacattcagtgaaaaacagctatatagtttaccgattttctacatgtctcataatttgatgaaaataaattaacccatgatctgcctttattc

SEQ ID NO: 411327 - DNA, 287 bp, Homo sapiens
aatgagcccatgctccttagcaggtcagcaggtaacactctccatgttttgctactaaaatgctcagcagtccagggcagtgcatgctacagccacatcgtgaattattttaggcataaaatattccagtgagagattggaaaattagcagattctcatgagattaggggcgaaggctactgcatttctctctctgtgtgtgtggccctctcttgctttctcttggccctgcttaagcaaaaaaataaaaatcagtccattccttcagcaccctcaaaaatattccc

SEQ ID NO: 411328 - DNA, 518 bp, Homo sapiens
gcctccctcaggtctgctgagaggatcaagtgggatatcatctgataaagtgatttgacttttacaaaggactgtccaaatagaaggttgtggtgttatctctgacatctgaagcgaggtccttggatgttcctggagtcaaacctgacaacaaggaaactttcagcatgaccgagaaaagggtctcccttagctcagctcctgggagggcccctgaaggagatataaaatgtgagtctgtgggtgggagtgattgtgctgggcatatttaatgtatgtcagcattcactcacacttttgagtgtgcacatcttatttcttgtatatacaaaactgatgtgtgtgaatgcctgtgtcaatatggtgggcagagagggtcatttattcgttcattccaggaatgagttttgaggatttactctgctctctagatgctggagattcagtggagaacaagacagactagcatttgcatgtacgtaagagtgtttataagaaaacatgagttcttaagtgta

SEQ ID NO: 411329 - DNA, 456 bp, Homo sapiens
gaaataaatatctatggctaattgattttcaataagtgttcagcacaactcaatggggaaagaatagtctcttcaacaaacagtgccggggcaactgcataatcacaggcaaaagaatgaagctggacccgtacctcactccatacacaaaaattaactcaaaatggatcaatgacccaaatacaagaggaaaacataggggtaaactatttagagaaaaacataggagtaaatatttataacctcagacttggcaatggattcttagatttgacaccaaaagcatgagcaacaaaaggaagaaatggataaattagacttcataaaaagtaaaaccatttgcacaataaaatatattatctagaaagtagaaacacagcccacaaaatgagagaaagtatttgcaaataatggacttgtatccagaatatataaagaacacttaaaactcaacca

SEQ ID NO: 411330 - DNA, 460 bp, Homo sapiens
gccgagatagtgccactgcactctagcctgggtgacagagcaacactccgtctcaaaaaaataaaaaataaaaaataaagagtttcctaatgaaatgacttaaatgtcacctccatgaatgtatatatacaaactttgctggattgaagtttcttcatcccaacccctgctgtctagaaatgctataaatgtaagtaatttaggaaaatctgattaaaattaagacatgtataatgctccagagaatttgcaataggaaagaaatgaaaacgtataactctattctctttctctttaccagtgcctcattcttaacatgaatctacactatgaatcctacttcttactttcatacaaaaattgatgtgagatatttttgcaagttttcttcacataaaggttcataagtcgaatagtgttttcttaatagaagcagttaataaaatttctttccattttg

SEQ ID NO: 411331 - DNA, 547 bp, Homo sapiens
cgagaggcgataggtctcgggagagcctggcgcagggtgtgggagattaggaatcccaggtccaccggagatggcagggggtggcctggcccggtgcggggccgcttgcctgcacgcaaccaactaaggcggtggtgcgcaagtagtggtgacggcgggcgcgcggagaaaaggaacgttgtgacggaaactccagctgccggagaccccaccgcagtgaggtcactggactccccggactcggggcgtgaccggcgccgacccggggcgccgagaggcccaccgggcggagggggcccaactaccatcccgcattttcctgggtctctctcccgggcggtgacgtgacgtgctgacggcgggcccgtgccggggagctgggccgctttttgtcagctccgaactcggcccctcctccctccctccgcccgccctaccagccggagcccggcccagtgctccagagaaaggccgtcctgcagcacccgccgctgtcgccgaccgcccgcacatccgtcgggtgagtcccgcgtgcccccgcggccgc

SEQ ID NO: 411332 - DNA, 341 bp, Homo sapiens
gactgaggatgtagacactgggcatcaggctagattgccattgtcagcttctttcctttccacgtgaacagggggtcagggaatcattgacagaggtgtgacagaactaaagtgctgtggttagagccatactgtcattagagtgaataaacccagtttcttcaggttcaggactttgcttaagaattgaccgcacggctacgtggttcgttcctttgacttttttgttttgtgtggaagaatttctcttcttttaatgtcagatgtaaaaggaatgtacacagtaagtcttagttatgtaccctgaataacctaaaataaacttacacaaattaatccta

SEQ ID NO: 411333 - DNA, 358 bp, Homo sapiens
gaatcctgccgctgaacatatacgaagagaaatgtgtgtgtaagtgcattaaatacatgtaaaggaagctaaaaatttattcacatgaatttcaaaactagacaaagctaaacaactgagttaaaagtcaaaatagtggttgcctgtaggaagaagagaaggggaaatagaagggttgtgatggcgcggggcagttcagggctgctggcagtgctctcttttgtgatctgcaaagcgattacccaggtgtttgctttgtgataataactgaatggtacatttttttagaacattactgtctataacttttacttcaataaagatattatatataaaccaaaaaattaaaaacaggaaa

SEQ ID NO: 411334 - DNA, 462 bp, Homo sapiens
ccctattttagttacaacaaaaatcactttttctcataatgtcactgttgtggtttgaatgatggtgtcctctctaaaactgatgctgaaactgaatcctcaatgcaacagcattaagaggtggggcctttaggtggtgattaggctattagagctctgccctcatggatatggttagtgtcttatcaaatgtcttcgggggtgagttcattccttctacctcctctgctatggaggatgcagcgttcatcccctcaaaggtcttcgggggtgagctcattccttctacctcctctgctatggaggacacagtgttcctcccctctggaagatgctgcaataaggcaacattgtggaagcagagagcagcctcacctgcccccaggtctgctgctgccttgatcttgaacttcccagcctctagaactgtgagaaataaattcccattgtttgaaaatcaac

SEQ ID NO: 411335 - DNA, 544 bp, Homo sapiens
actgcatctatagtgtgtaccatgctaggcattgagggtaagattaagtttgtatctgtcacaagttatgagctcctctgagcaggaaccttaaatagaccagtgcagagtggaacatgtggattaaaggtagcttagatgaagtgcaccctttggtgaacttattattcactcatttgtttatttttcggcatagcctcttccaaaatagcctagcacacaaacctgggcttccacaggaggtgggttaaggtccatggaacctcttgaattaaacttgttagcttagagttgttttttgggattgcaaacactgctgttcctgtggggcgaaatatttctgaaattctgcaaacgtaattgtgtctttccttatactttacaggtatcgtgcatttcaaagaatatcattatgagactacatgggtatcctagcaaataactcatattttgctgacatagtagtaatacattcttttaagctcaaaatgctataataaatacatgtctttaccaggatttgtgctttttgttacgaaaaata

SEQ ID NO: 411336 - DNA, 319 bp, Homo sapiens
gcctactactactactactactactaaattcgcggccggtcgacttggaactacttttgtcagtctaaaatatttttctatgcccttaaatagttcataaaccctagaaccatatctttattgcctgacagataaaacaagtaagtcagtgttgatgaaaactctagagattaactttgagtgtttgatgtacctagtgagggtgaaaattatctgtgaagcttctgtaatatggggtagaattttcaacctaaaaaaagtgaactaggagtttcaagaatatgtgactagagtggagtggggacttgcctggctgaag

SEQ ID NO: 411337 - DNA, 598 bp, Homo sapiens
catgttggcatttaagtttttcaccaatttattgctaagaggaaacatataataatatgctatagggtcataaaacccactttgcagctatagaagcaagttctgcctgtgcctgtgtatgtgtatgtatgacagtggacatgtaagtgtgaaactttaaacactattacagtaagaagtcttttgttgaacttttgttagtttgagaggctgcaatgatttttctcctttcaaaatgctgaaatagaactcatcattttgcttttcaaattagcaacaggtagctggtttggaaggctggagattgatttctctccagctagcaagtcgtggggtcaggtcactgaagcatgtgggtgatatgctgaaccaccaacttggcaaatattgaactattttaagtgcatctattttctggttcagtaaattttttgttgtgttaaattcattaaactcgacacagtctaaatgccacagcacatactggagaacccataaagtaacagcaacagctataaaatatagcaaaaggtaaggatcgatatactttctctctgtttctatttaatttttatctttcatattaggactggaattt

SEQ ID NO: 411338 - DNA, 447 bp, Homo sapiens
tttttgagatagggtctcagtctgtcacccaggttggagtacagtggggtgatctcagctccctgctctctgcctcccaggttcaactgattctcccacctcagcctccagagcagctgggaccacaggcatgcaccactatgcccagctaatttttggtgggtattttttggtagagacggggtttcaccatgttgcccaggctggtctcgaactcctgagctcaggcgatccacccgcctcggcctcccaaagtgctgggattacaggcatgagccaccgtgcccagcgtaagtttaccactttaaagtgagtaattcagagctatctagcacatttgcaaggctgtgcaacctccacttctgtctagttccaaagcccttccattgccccacaggaaaaccccacgcccaccaacagtcactccccggcccacacccccagcgc

SEQ ID NO: 411339 - DNA, 286 bp, Homo sapiens
tatttttaatagagacgggatttcactatgttggtcagtctggtctcgaactcttgacctcgtgatccgcctgccttggccttccaaagtgttgggattacaggcgtgagccaccacacctggaccattctggctcttaataggtattcactgaaagtttattggcttgctaaattcaaaccaagaatatcctaatctagtttttcaaaggactattaatacttccatactagtaaaatgatctgatggcaattctataactaacatcttgaatggtaaaaaaaaa

SEQ ID NO: 411340 - DNA, 233 bp, Homo sapiens
ggaagaaagaagatttaactctcaggtagctaaggtcagcttcatatcaaaggtgaaaattatgaaaatacataatgtgctgttgggtttttaaattgaaaaaatagcaggaataggctgggcagggtggctcatatctgtaatcccagcactttgggaggctgaggtgggcagatcacttgagcccaggagttcgagaccagcctgggcaacatggtgagacccctgtctac

SEQ ID NO: 411341 - DNA, 294 bp, Homo sapiens
tcctgatggaatcaaagaattgttggagttgggggagaagaggaaagttggaaagctagtttggagtcaaaaattggggtactttacaattgaaattactgagattgtagttactggtaatgccaaggtcgctgggtatcagcatgggagtgaatggctgacgtagaatggaagatagattcattaaatcagaggagttcaagaaatcaagagtccatgacactggagaaaaataatcacaaaagattatggcaggagtgctgttggagagcatgatagtgagctacagtctac

SEQ ID NO: 411342 - DNA, 545 bp, Homo sapiens
cacattctcctagaggagttcttctgatgtgagaagaatgtaaacccaaaccacaagggagtattcattgtacctatgcacttgggaagagtttgggtgcccaaaatgtcagaaaaatcagatacagttgttctcttagaatctattctggaggtcacaaggtcagaatgcctgcacatgtgcataaaccaacatgcccataaaagcctgataggaggcagcagtgccccataaaaggtcacacccagccagaatccagcaacgttggaacagcgtctgttatggagaagaaatatgtgtctgacagcagcaacagcagcagcagagaaagatggattggggattaatcatggtaagatactgagcaaaagagacaacaaattctgccaagcatgaatccttctctactcacaggtttcacaaaatacactcttcaaagtacaagctggttggccaaggtcaggttgatctttgctaggctaaagaagcagctgcggagtgtttcccacggcagatggagaacacctaaggattttttactgtta

SEQ ID NO: 411343 - DNA, 333 bp, Homo sapiens
gaccacctgttggccttgtggactggcttgatgatactgaaagtgtggccacagatggttgttgagctgcattgctgacctccaggaatgtataagaaagcctaaagcaagcaattaaacagccactggaagtgataacacttgggagtttgattatccttatgtcagaaggaaaatttgtattttctctttattgtctataaaagataaaaatttagataagggcaacttaacttttaaaaatctccagtggcaataaaaaaatcttcattaccacatttctgttgaattgtattttaaagttcctaataaaatgacatcatttactgggaa

SEQ ID NO: 411344 - DNA, 445 bp, Homo sapiens
atttctaaagtcatctacaactggccttaaaaattagatttgattttttaaatcttaaaatagtggttcagataagttatagatttgaaacaaaataataaatggaaaacagtgagcctcagtatgaattcctgcttctaaaactgctttgatggctcggcgcggtggctcacgcctgtaatcctagcactttgggaggcccaggcaggcggattgtctgagctcaggagtttgagaccagcctgggcaacacagtgaaaccctgtctctattaaaatgcaaaaaattagctgggtgtggtggcatgcacctgtagtcacagctactccggaggctgaggcaggagaatcgcttgaacccaggaggcggaggttgcagtgagccgagattgtgccgctgcactcactccagcctgggggacaaagggagattctgtctccaaaaa

SEQ ID NO: 411345 - DNA, 219 bp, Homo sapiens
tatgacaaatgttccacattttgacaatatgataggtttatgattatttatattccaaatgatcttactttttaaaagtaatattttgtgcagtctttgcaattctgttttcctttctattgttatttagaagctattcattggcgtttggcatcattcaccatctttgagcattaaaaagaaaaagaaaaaagcaagtacactctgtgtagcatagaa

SEQ ID NO: 411346 - DNA, 430 bp, Homo sapiens
taaatttctgttatttataaattaccctgtctcaggtattttgttatagcagcccgaacaaattaagacaaagggaaactaagataattagttgccaacagaccttcactaaaagaattactgaaggaaattcttcacagagaagggagattatatcagaagtaaacttggaggcaggcacagtggctcacacctgtaattctagcagtttggcagaccaaggcagggggattgcttgagttcaggaatttgagaccaactgggcaacacagtgagaccagtctctacaaaaaattttttaaaaaaattaattgggcacggtggctcacacctgtagtcccagttatttgggaggcttaggtgggaccacagattgcttgagcccaggagttcccggctgcagtgagctgcaattataccactccagcct

SEQ ID NO: 411347 - DNA, 314 bp, Homo sapiens
tctgcagctatggagaccaactcacacatattatctcttctacctgtgatgcttttgaaggcaagatttatgccattttgacccagctccatgcatcttgtacttggccccctttcatgcatggacaaaggggcttttctagtgtgggagatctgaaaggatgagatcctgctccacaagcatggatgcccacccctggttttctaagaagcccacctctgcgtgccaagagtgatgcattcatttggggtccacttggagttcaagcgcaggcctgatgtttgtggtgcactttgaatcttctctagcttctt

SEQ ID NO: 411348 - DNA, 442 bp, Homo sapiens
gagacccttacagcttttcttagatgcctcaggctggacagaagggattcctggcctgctgggtacctgtccttttagaatcttaccatcatcctgaggattccatttgcttctgttgcattggatcctctatttcttggattccttattgttctccttgatttactccatcgatttggcaggacatatcctgtagtggtttcccgagaaagagcgtgttataggacttccaccccagctacctcccaggtcctgaggatttggtgtgcaaacttagagctacatcatcagctttcctggttctgaggccttcagacttggactgagccactcaactggcatctcaaggtctccagcttgctgacagcctgctgtgggacatctcagcctccataactgtgtaagccaattcccctaataaacctcctctgatatatctaaa

SEQ ID NO: 411349 - DNA, 640 bp, Homo sapiens
cccggaaccaccctgctctcaggcggaacccgcgagcacacgcagcagagctctgctcttcctggggttttaaggatgagacattgcaaggtcccccgggctacacagtgacccctctggcaggttgtgcccccagagttcatggttagaatccaaactctcagtaccaacaacgcgagcgtgtgtggagaaggggctacgagacaggtgagtatgtgggaagcagccgtgaggatgagccctggccgggtcccactggtgtcctagttgcaggaggaggttagggcagagggacacgggacggacctgcgcagaggccgcctgagagaaggcagcagcgggagaggcctccgcagaaccagcccggcaaccctgggacaccggaccttcccctccccctccgaggctgtgagaaaatacatttctgttgcttaagtccccaggctcggtattttgttccagcagctggagctaggacaaccccagacgcacccggccagccctgagggagggcgttcaccggcttcccatacgcattgtaggaggccgcatgggcaccctcctcagccctgggcacccttgtcgtacctgacaaccctgtgtagattccctgcaagcatccaggggcccaggcggccgc

SEQ ID NO: 411350 - DNA, 440 bp, Homo sapiens
tagtcccttaaccccatcagacccctctgcacctcttttagatcctcttcccattcgattttggttgtcagaatgcacatgatcatatagcctaggtccttccccattgtatgtagatatgtatttttttggagtttataatttttttttaattgatatataaaaattgtactcttattgtgctaaaaaaattaacagctttatcatatatttcacatgtcataaaattaaccctttcggctggtcatggtggctcacgcctataatcccagcactttgggaggccaaagcaggaggatcacttggagccgggagttcaagaccatcctgggcaacataacaagacccctgtctctacaaaaactgaaaaagaaaaagaaaaactagccaggcatggtggcatgctccggtactcctagctacttgggaggccaaggcga

SEQ ID NO: 411351 - DNA, 392 bp, Homo sapiens
gacacctgtcactgccactcacatttaactggctaaaacaagtcaagtcatatggccatatccgagttcagtggagtgcagaagagcctggaccgaactatactagcacggaacgatactgtactatagcccaaaaaaggaagggagccatatacttgtgaacagcctgaaagactaccacaaaatgtaacagaaatggatgcagaatgtggtgtctggaggaaagcatcaatcttgtcaacatgaggatgatagccacatacatgtttaggacagtagaagaagcctgtatcctggaggccttccttgagctgctgaactagtcctgaattgtcttcctccaggtttcctgtgatgagagaaaaataaagccccactggattcaacctctg

SEQ ID NO: 411352 - DNA, 456 bp, Homo sapiens
ttgagggagaaggctgcaaggagtcctgtgggaggccctggggtcttattagttgaaggaaacaaatcatcatacctttaatactggctccaatttgcccctttcatgagtagtcttggagagataattgctaatctggaatggacatacttcttgatcttggttggcatttttcaaactgtgatgaagacactttttatagccctgttcagaatacagaaggagacctactcttctttgatcacaatctaaagacagacagaggacatgtggaaagatctgtcatggattaaatataaacaaaaatgaagcaagaaacaaaactagtctttcaatgaaaagctgaagatgctgaagaagaaatgcaaaatcatttcacaagaaaaacaaaatcagaccaggatcacttggcgtaccatcctagcaaaatatatcttcttggagttgccctgacaa

SEQ ID NO: 411353 - DNA, 376 bp, Homo sapiens
cagaagagattagcatttgaatcggtagattgaataatgtttgccttcaccaatccaggtgagcgtcatgtcatccactgagagctcaaatagaaaaaggtttaggaagcatgaatttgctgtctgcttgagctggaacatcaccttctcttgccctcaggcatcagcactcctggtttgggggacttaggattcagactgggacctatgccattggtttccctggttctcaggcctctgggcttcattggactggaactatactaccagttttcctgggtcttcagcttgcagatggcagattgtggaacttctcagtcttcataattgtgtgagccaatcccccataataaatctctttctctatatctacaca

SEQ ID NO: 411354 - DNA, 544 bp, Homo sapiens
caacccaaaaaaacagacataagacatctgccctatggctcttggcaacttagaaattgtggggcctctttcctgagaacagcagctggggaccatcctaggattcaggacttggagtcatttggagcctctcccttgccctgaactggacctacttgcttgaccagagccccacccagcctgtctccaggctctggccttactcttggcccaagcatctggctctagagatcttctaatatccaacaggccaggtgggcagacagtggaaaaagctggctgaccagctaagcttgacaagagaaaaccaccagggagccagggcctggacagggaagctgggtttggaggaagtggctacacctcgctccagggaaaggactgcctgctcactggaccctttggtcctggcctctgaaaacccaaatctgcttccctccttagagcaagtgctgtagaggctggaagaactgaagataattttaagtcttatagctaagaatggagtttaaaaaaaataaagcctactctcctcaaatggtcc

SEQ ID NO: 411355 - DNA, 349 bp, Homo sapiens
ccacttggcacagataagttattcagtaaacattaacatatgtgcatttatgtttaaccatgggtttaagtgattatccagaaatttccctctctttgactatgtttgaatattagatacttcttaatttatctttgctctgaatttgttttttttcactcgttgtatactcatggaccattttatgtgtttcaggaattgatattttacttaaaaactgttactatagaaaattaacttttggatagtcctgttcagactaaaactatcatttgtaagatctgtattactgcaatcattggtgttaatactttgcattaattaaaattttttatggacatataataag

SEQ ID NO: 411356 - DNA, 3486 bp, Homo sapiens
  misc_feature (2281)..(2281): n is a, c, g, or t
tggcggagaaggcgctggaggccgtgggctgtggactagggccgggggctgtggccatggccgtgacgctggaggacggggcggaaccccctgtgctgaccacgcacctgaagaaggtggagaaccacatcactgaagcccagcgcttctcccacctacccaagcgctcagccgtggacatcgagttcgtggagctgtcctattccgtgcgggaggggccctgctggcgcaaaaggggttataagacccttctcaagtgcctctcaggtaaattctgccgccgggagctgattggcatcatgggcccctcaggggctggcaagtctacattcatgaacatcttggcaggatacagggagtctggaatgaaggggcagatcctggttaatggaaggccacgggagctgaggaccttccgcaagatgtcctgctacatcatgcaagatgacatgctgctgccgcacctcacggtgttggaagccatgatggtctctgctaacctgaagctgagtgagaagcaggaggtgaagaaggagctggtgacagagatcctgacggcactgggcctgatgtcgtgctcccacacgaggacagccctgctctctggcgggcagaggaagcgtctggccatcgccctggagctggtcaacaacccgcctgtcatgttctttgatgagcccaccagtggtctggatagcgcctcttgtttccaagtggtgtccctcatgaagtccctggcacaggggggccgtaccatcatctgcaccatccaccagcccagtgccaagctctttgagatgtttgacaagctctacatcctgagccagggtcagtgcatcttcaaaggtgtggtcaccaacctgatcccctatctaaagggactcggcttgcattgccccacctaccacaacccggctgacttcatcatcgaggtggcctctggcgagtatggagacctgaaccccatgttgttcagggctgtgcagaatgggctgtgcgctatggctgagaagaagagcagccctgagaagaacgaggtccctgccccatgccctccttgtcctccggaagtggatcccattgaaagccacacctttgccaccagcaccctcacacagttctgcatcctcttcaagaggaccttcctgtccatcctcagggacacggtcctgacccacctacggttcatgtcccacgtggttattggcgtgctcatcggcctcctctacctgcatattggcgacgatgccagcaaggtcttcaacaacaccggctgcctcttcttctccatgctgttcctcatgttcgccgccctcatgccaactgtgctcaccttccccttagagatggcggtcttcatgagggagcacctcaactactggtacagcctcaaagcgtattacctggccaagaccatggctgacgtgccctttcaggtggtgtgtccggtggtctactgcagcattgtgtactggatgacgggccagcccgctgagaccagccgcttcctgctcttctcagccctggccaccgccaccgccttggtggcccaatctttggggctgctgatcggagctgcttccaactccctacaggtggccacttttgtgggcccagttaccgccatccctgtcctcttgttctccggcttctttgtcagcttcaagaccatccccacttacctgcaatggagctcctatctctcctatgtcaggtatggctttgagggtgtgatcctgacgatctatggcatggagcgaggagacctgacatgtttagaggaacgctgcccgttccgggagccacagagcatcctccgagcgctggatgtggaggatgccaagctctacatggacttcctggtcttgggcatcttcttcctagccctgcggctgctggcctaccttgtgctgcgttaccgggtcaagtcagagagatagaggcttgccccagcctgtaccccagcccctgcagcaggaagcccccagtcccagccctttgggactgttttaaccttatagacttgggcactggttcctggcggggctatcctctcctcccttggctcctccacaggctggctgtcggactgcgctcccagcctgggctctgggagtgggggctccagccctccccactatgcccaggagtcttcccaagttgatgcggtttgtagcttcctccctactctctccaacacctgcatgcaaagactactgggaggctgctgcctccttcctgcccatggcaccctcctctgctgtctgcctgggagccctangctctctagggccccacttacaactgaccaaagtggccccctctgggggtccccaccacacaagtgtttgtaaactgggctgctataaggttggagttccagggctgggccctggtggagtccactggaagtcccattatggatgttgaaatggacagggaaggactctggaagtctcttcctcctcctcctcttctctccacccctagaccctggctgacttggacaatctgccaggacagaagctgggttttctgtctaggtcaccactcccaatcctggggattggagaggcctggggctgtgggatgccccatccccctccccatcacctttggtgggggcagggcctggtggcacctgtgcaataatgtctgtgtttctctcccacctgccactggaactggagaatgcactttattctgggcggggggtgagtgggggaagacccaaccctcctttctcgctgcccctaacgcatgcacggtctcgtgatgctccctccctctccggagtgacaggcacatacatgagaacaggccatctcagccctacacacttgccatcccctacagcacagaggaagagtgatggtggcatgctggtggtggcgggtgctggtgggaggacagtgccaacctcctcctggggatcccatgttggagactctaaggataaggctggtgctgcccagggtgtctacaggaactgcaggtgtctacccccaagtcttccctcctcccaagccaggggtggcacagggcactagatccctggagttcaggaaccaacacaagcacaaccacgggcataagttggccttggccactgccacccacggccctccttttgtgctccatgctggcatcttcactcccctaccccttccccagccactgctgctcattcaaacttctgtccatgtccctccactgttcctatcagcaggtggcccctgggcatcagaacagcctgccctgggcaccaggtggcagacacactcagagcatgtctggctttcctggtgggtccaggctcattctgcttctgatttcccctcccccagggctcattttccccctttttcctgtacacatccctgtctacctcctctcaccctgccacagattcttcctatcacacagggatgccagttgtatttgtgggatttcacccattattaataaaacctatatttatacagt

SEQ ID NO: 411357 - DNA, 376 bp, Homo sapiens
agtgcacttcagcttaggtgaccgagtgagatcctgtctccaaaacagaagggaaaatacttatttttaaatttaaagatataaaataattataatctgtgtcctcatataattcattatcctcaaataattcatttttttgccagcattagatatgactatgcagaacaacagcaaaaaagcccagaataaaacctatcgggacaaatcgaatgttggaatgtggctgggcatggtggctcatgcctgtaatctcagctactcaggaggctgagacaggagaattgcttgaacctgggaggcggaggtcacagtgagccaagattgtgccactgactatactccagcctgggagacagagtgagaccctgtctca

SEQ ID NO: 411358 - DNA, 365 bp, Homo sapiens
cctcccaaagtgctgggattttaggcgtgagccaccgcgcctgaccttacatgtttttttaagtgaagcaaggtctcactgtattgcccaggctagtcttgaactccaagactcaatcctcccactttggcttcccaaagtgctgggatcataggcgtgcggtaccatgcccagccaggttttttaactgtagcaatttaccatattaatttaagatgttcataacaaggaagccaggtacaagggtatatgtgaactctgtgctatcttggcaatttgtctgtaattctaaaactgttttaaaaagtttactcaacttctcaatgtgctgctaaaggaagaaataattaaaatattaaaagtgt

SEQ ID NO: 411359 - DNA, 873 bp, Homo sapiens
acaggagtcaggagccgctggcaagagacagcatgtcacccgggactctgccggtgcagaatatgaacaatgccatgttcttgcagaaaacgcttagcctgagtttcataggaggtaatcaccagacaactgcagaatgtagaacactgagcaggacaactgacctgtctccttcacacagtccacgtcaccacgaatcacacaacaaaaaggaggagagatattttgggttcagaagaagtaaatgataatgtagctacatttctttagttattttgaaccccaaatatttcctcatctttttgttgttgtcattgattgtggtgacatggacttgtttgtagaggacaggtcagctgtctggctcaatggtctacattctgaagttgtctgaaaatgtcttcatgattaaattcagcctaaacgtttcatcaagaacactacagagtcgatactgtgagtttccaacctcagcccatctgtgggcagagaaggtctagtttgtccatcagcattatcatgatatcaggactggttacttggttaaggaggggtctaggagatctgtcccttttagagacaccttacttatgatgaagtatttgggagagtggtttttaaaagtagaaatgtcctgtattccagtgatcatcctgtaaacattttatcatttattaatcatccctgcctgtgtctattattatattcatatctctacgctggaaactttctgcctcaatgtttactgtgcctttgtttttgctagtgtgtgttgttgaaaaaaaaacattctctgcctgagttttaatttttgtccaaagttattttaatctatacaattaaaaacttttgcctatcactctggactgttgg

SEQ ID NO: 411360 - DNA, 311 bp, Homo sapiens
gcactcatttccacaacttaagggggcagtgcaaagaaaagagcccacagtagcctggggcagagactaatgccttggtacttcagtttcccctgccttaacatgcagagttgagggtacataagtatttctaccactgcagaatatagagatggttttagatggtacagggagagccttaaagaatatggtggccaggcgcagtggctcacacctgtaatcccagcacttcgggaggccaacacaagaggatcacctgagcccagaagttcaagaccagccaggcaacatagggagacccctgtctgtac

SEQ ID NO: 411361 - DNA, 340 bp, Homo sapiens
gcttactgcagcctctgaactcctgggctcaagtgattctgccacctcagtctcccgagttgctgggactacagacttgcaccaccacagtcggctatttttttttttaatttttagtagagatctcgccttgttgcccaggctgttcttggactcctgggcttaagtgatcctcccattttggcctcccaaagtgctgggattccaggcatgagccaccattcccggctgttttacattttgaagtggttgaaaaagaataaaaattgtaacattttatgacatatgtaagttgtgtgaaatttaaattgtagtgtttataaagttttatggaaacagc

SEQ ID NO: 411362 - DNA, 334 bp, Homo sapiens
tcgtgactaaggaagctggaaggaaaacacgtaagaaagcacacgttccatctcctggcttctggcccatacataatttcatttcagaaagccaagatccccatttctagaagatctgtaagagaattttattcccagagaaatatatttaaggaaacatccatggcctaataaaatgaacaaagaactgggaatcagcagttacaagttttgtggaatggggtaagctcacttcacccctcagaacctcagtttctccatttgtgaaaggaaaaataataatctcacactgattaacagcattagggcaatcataaatgtcaaaggaaattgt

SEQ ID NO: 411363 - DNA, 575 bp, Homo sapiens
tgtttaacatttacgaaagaacagaatcttgctctagagaaaatgtatttttcttaatcatcatttaacttgacatttctgctttatttaattataaatctaactgatgtgacaaagacctgatgtttaatctgtcagttcagaaaatttggcacacttaaaattttccatttttataggatttcaatgttagctaagaccttaacttactcgaataaatatacctctagtaatacttcatactaattcaaaagaaataatgttaccatttgtgtttctgcaatattattcccaaaaaagttcataaataaaactgtattctaaaacttgtcaaatataacatcaagtgaaagttaacatgaattttgaaaattattagcttttataatttatgttgaatatgattttgcagttgaaatgctgtatttgaaatgtgaaatatagttggttgtatgagttcatattttaaaatgaatatactgattaactgacattttagcccagaacattagacattattttttacaaattattctaaacccctatatattaaaatatagatttgcatgaattaa

SEQ ID NO: 411364 - DNA, 413 bp, Homo sapiens
tacaacgtaaatgttatgtaaataattgttacaatgtattttaaaaattttttatgtatttttttctaaactattttgatctacagttgaattcacagatgtgacacccgcagataaggaaggcctgctgtacatgaattcttcctgtgtctcttctgcaaaaaaacctgccatagccatctgtactgtcatggataacctagggcttacctataccacacatctcattctccttacaatttagttttaatataagaagaagctgcattcgactatgttgccacctaaattttcttatcaaaaactcctcatccaaccatccttttcttacctgtgatgcctaagctcaaatacggctgtttttgagtgtgtaaggtaaataaaggaggacctgcctcacaactgaaaattgc

SEQ ID NO: 411365 - DNA, 319 bp, Homo sapiens
tgaattctgttgccaaaaatatgggaagtgctgcactcgctctatcatcctcattgattctcagcccttactggcatattaaagtctcgagaagtcccacctgaagaaaactaatgttgtttaacccaggttctaccaaaagcatttgagcattggacatttttgcctcctgttaaaattctgttgggataatattccatggaataaaaggacactgctctaaatacataaattgctgcttatgtgacactgagctttcagtttcctgggtgccagccaataatatggaggaataataaagtaacatctagaaaacaaa

SEQ ID NO: 411366 - DNA, 228 bp, Homo sapiens
tctcgaaaccgccatactgcccctgcgcccagctctcctgatcccctcttctggatttatttttttccagaacatatactttctgcctctcacaacgtggcacacgtctttcaactatctccccaaactggaaggtaaatgtggacaggggttctgccagcacctacaactgtgcctggcacattccaggggttcagtaaacacttgctgaatgaatgatgcatgaat

SEQ ID NO: 411367 - DNA, 267 bp, Homo sapiens
caatgctgagttgtggacatgtgtataaaccgtaatgctgtaagttaggcctctcttgtctagaatctcagcctcttcatactctctcccccttttttgccatattattttccttatcactaactatatattttacctgtctcacttactatctgtctctcctctcagagtgttactccaggagggcagagataactgtttagtccaggctgtgccttcggtgctcaaaataatgcctgggtgcaaaataaatatatcttgaatgaa

SEQ ID NO: 411368 - DNA, 316 bp, Homo sapiens
cctgttctggatgtttgtgatgcaaaataagagaacaggcagaaaagcatttgaaaggtgagctctaagggaaaggtttatggagagtagctaaacagatccacataaggattggggagaattaaagaagagagaggagggaatttgaaactatggaaacactgcaaaagcagccatggaaataagaaaaaacaaaacaaaacaacaaacagaaactacgggaactgctgggaactgtgacttggagccttttttattcttttttctttcaagaggcccatgctaaagactaaaatacattttaaaattatttttg

SEQ ID NO: 411369 - DNA, 276 bp, Homo sapiens
agctttatgaatgttatgagtttaaaatatgtcaatttaatactatgatttaaaaaacaatagcagatttcgtatgactgtggggacatggaaaaatcaagatcctattgattgctagctctggctcacttattctccggtaatgatactattggatatataccaaaattatataagcaaaaagaaaaaaaataagttttcctggcccaggtcttccattcttctggtccccttactatagtaattctagttactctcatcttattctgaggaaaa

SEQ ID NO: 411370 - DNA, 351 bp, Homo sapiens
aacttgaattatatattttcaagaagtttcccagagttatctctaatttctttgatatatatttattacccattatgatctgcaatagttctattcaggaatatgaggtgaatatataatgactgtaaaaatatgaaaataatatatatttgattttctaaagcaaaaaagtcactttggatctaatggatttctagaaagtctaattaattaattaattactaggccccaattttccatactattttcctcttaagtaagatagttaagttcacaggaaagtattaacaaacgatggttggacaaatgtatgtttttgctccctaaggagcaaaaactctattattgatt

SEQ ID NO: 411371 - DNA, 483 bp, Homo sapiens
gtgagtgggaaacttttcttccattctataaccttctcatctagcaccatgcttttgttccttctgaaagaaagaggcttgctgaacacaagacctgcagattggaagctaatcagtgttccttctctagactcacacaagctattcatgtgtgacaatctggacaaccctccgatccctatatgcggggaagtttagttcagttcagtgctctgtcagggatggaagcgcagagagagagagagagtgcattccaaagaacatgggctctagcagtgcctgttttatggactcgaccagcctctgtcttagagcaaataaacttggtgcccagacctcatctgctgttttctccctagcccttccttcccttttgtggtgtctacccctcccacctttctgtgcccctctttccctgagtacccaaatctttcttctcccatcttaaagaaagcacttgctcaataaatctacccccagaaa

SEQ ID NO: 411372 - DNA, 625 bp, Homo sapiens
actgattttgttgtttgacaaccaataagcttttccagctggagatggaaagaggcttgttaaggccaatgtcacctttattgctgtagaaatttcattatgtttaaaatagtaacaggcagtagaccacttcggtgcgcacctaagcctacgtctcagggagatggccacctggcccgcctccacgagcagtttgtgtcacagatggccggaagagactcttttgcctggttacaggcatgtttttctgccatcctgttgaattttcccatcaactcctttgtccagaagtctaagggctctattgagttggctgacagcttctcatattgtaccaataaacagaatggaaaagaaaattttttccagttcagtattttcctctatatttatctttttctttaaaaaaaaaaagtatctatcaaaatgaagtggagcaaatgggtactgtgagctccagtataggcattgtgaatgatgtttcaatatatagaaggctctctcctttcacaggggcatgagtttggaaatctccaggaataggaaatactgtgcttcaacagggcctcgaacctcagtttgaacagcgattctcactagttgtctttgactcaaaactgatggg

SEQ ID NO: 411373 - DNA, 509 bp, Homo sapiens
aaaaaatggtagaatatcagagtttgctggtaagtattgtaaaaataccagagtttgctggtgagtattgtccatttcagttatatatgtgcgcacgtgtgtgtggtgtgtatgtgtgtatactaaattgcatataaaatgaatttcttatcatgggttcacctgttgccagaaaacactggaagtcactgttccagggaatggaatggtggaagatgcctggtgggggatggaggtggattctgtttccagacacagtaaaaaaaaccagtataaagtccccaattatgcattgtcagtgtctctatgtgtagctggaaaccattcctgcagcaggtaagcaggaagaaccaaattgtcgagaggcacttcaggaagggaagtgggccgactgaaagctttggaggcctgcctttaagtagctgcttttctggaaacttcaggagttcgagaccagcctgactagcatggtgaaaccccgtctctactaaaaatacaaaaaatacaaa

SEQ ID NO: 411374 - DNA, 369 bp, Homo sapiens
aaatatacacatatttagcctagaacagtgatcttccagcgtctgtgaactcactatccccaagtcctggttgatacgtataattatttgctaaaaggaatgagaactttctgggaaaaggtctgattccaaggctagggcagcagaagttcaagataaatccaaaatatcttgtcctctggaatgtgagaaagtgctgtggaataagagggaagaaccaaaaacaaaaactagctcaaagagttttcccttcaacctatggcagttattaaataaataagaaatctgagttcacactgatataaaaataagaagaagaaagcaaagctctttttagagaaggaaggcaacaaataaaacatttcaaaa

SEQ ID NO: 411375 - DNA, 445 bp, Homo sapiens
attggcttcaggaaggctctgttaaaagagaaccatcctccatgagacaagacctgtcctttccatgggagaggcagtcattgacaagtgtcctccaacacattttcccagtttatcatattggcactgaaggaacactcaggtaagtattaattgccttgagattaaaaaaggaattcagccattaaccactcttaacattttgttgtattcactgcccattttatataaccacttaaaactggaatcatatcgtgtaaagattttttgtcacttgttttctttacttcgtgtttatattatctttacatcttcttactaataaaaaaaacttgctttcacagttgcattggattccatatgtggagttactattatttattaccaatttggtatatgggacagttagttttattttcctgttgtaagtaatgctatagtaaac

SEQ ID NO: 411376 - DNA, 403 bp, Homo sapiens
ccatgtgtgatgtcatctttatttcagcctcatacttgagtaataacttagctggttgtagaagtctaggttcagagtgtctttctgcagacctttgaaatgatttctcccatcacactgtattgcccatagaagcctggtgtcagtctaattgctgtccttctgtgggtatgatatgcagcactgattgccggccagtatctagtccacccagcctacctctcatcaccagactttcctgtgagtgaccatcagtccccttcatactccattattttgcagaaggctggatattactcccagtcccatccatcatcacatcttcagggtcttaggttggcttaagccaatcagcacgatgcatatctgcagatccattggttcaagggtgggcatgtgtttt

SEQ ID NO: 411377 - DNA, 214 bp, Homo sapiens
tcctccttcctcctttccctgccgctttctgtttttcatcagggccttggaactcgctagtacagaccgactttcaagttaagtctttcaaggaaaatgactcttggtttccagcctggatgtgtcattacaccctcatgcgtctcagggaaattagcaacctgattcttgccctgactgtcatttaaaataaaaagctttcttatttgccatc

SEQ ID NO: 411378 - DNA, 320 bp, Homo sapiens
taacttactgcatttccctctgatttaacttctaaaaagttcagaatatctgaagagaaatttcttctcatttcactttactttttgaaataaatctcattaaaaaaatcaattttactgcagccattttgaatgtagtttgatgagtctgatgaatgtctacatccatgcaaccacaccatgatcaagatacagaacatttccatcacctcaaaagtttgctgtgtttaaagtttaaaaactttaaagtactagacatccagtcatcctcaaaccaatctttgcattccacctggactgttttaaccactgtctcaaaa

SEQ ID NO: 411379 - DNA, 459 bp, Homo sapiens
ttgcaggctgactactgatctcaaaccaagcacagactgagacaggctgtatagctcagccattgctttctttctcctttacccaaaattaaataataactcaagttgctgggcatggtggctcatgcctgtaatcccacctgtttttgtttaaattacatatacatatgtgcaaagaagagagtttaaaaggatacacgatatggttatagaacctgtctctgatagaagattaagtttttcatttattctatatatttgtctataatggggttttttataataagacaaatgatatctaaaaaaaaaataaagccagcttgtccaccccacacctctaggtgtgctacacgtgaatcatgccagagatactgctctgcaaagcctccaaggaaaaagattctataacttttcattataaggttttcaatagccttgaagatctgttagaatacaaag

SEQ ID NO: 411380 - DNA, 207 bp, Homo sapiens
ccacccacaggctctgaggctcccccgacccctttgcagatggaaataatggcagcacctctggcacaaggcagttgtgagaactgatggtgatgtttcactggtttctttcaatgcttcttgttttgttttggaaaacaaccagagcagtgcctccacacagcaagcgcaatataagtatttgttaaataaaaatatggagaacac

SEQ ID NO: 411381 - DNA, 409 bp, Homo sapiens
tagtaaaatactaggctttactgcacaggtgcaatagtgttcatgagtgtagatttctggtattaaggcagtcctcagggaaatttgtagtgcttctaggaatattatagatagacatgaccataattatagtattcaggtgatacattcatgaaatagcctcttgacgatcatatatctatggtttcaagagcgtgtacagtgagagaaaggatgaataaataaactgggaaaagagtagagagtgggtaattatgtggaaaacgcatgtcaaataaaggccatgagatcaattagacatttatggagtacccctatattaaatgcctatactaggcacagtggtataaaatgataagcgtacttatttggggatggttgaccccaagaaatttataatactattcag

SEQ ID NO: 411382 - DNA, 540 bp, Homo sapiens
aaaagaagctttcctaattcattagaacatcagttctccccagacataatgttcatcatggaagtacttttcccctttggagatcactggaaacagcttctggaccacaaatggggtgaactactgtatcgagaaaggagagagtaagacttgagagctatctttttagctcagggtgcaggactggactaagaactcagttaagtgaagcaagcaagaatttcccaagtgatgccaactcaaaatgaattatatcaagaaaggaaaagcagctttttcatctggaaagaactggagaccttgaacctaggcagcatgtgccttgaacctaggatcagtaaacaacaaggatggaaaagacagtaagaatttggtcagatcaccatatctttccgttgtgcctttagaacaaaaggaaagaaaatatctctttggctcacagagaaaatatgttgagaaatgaagtacaacccctcactgtgctgggcacagagcaggtgctcggtaaataaatagtgtacgtgttcgctgagtaaaaaa

SEQ ID NO: 411383 - DNA, 422 bp, Homo sapiens
agcactttctcaagttgacatttgaaaacctttattagtgcatttgggaaatgaagataatagaaactatatgggttctatttgatttatggcagtgtgaagatggcttgctcttctgatgtgggtccataagaaactcatgtacatggcaaaaactcatttgccactttcataggaataaaaaaaattatgccattagttccttcatagtctgagatattggattgaaataaataccatttatattcagccatttgcaccttcccttccacacactggggggaaaaatgtgttttgcctgttagaaatgttaaaaatcatgtaaataaaatttgagcagctcttagagtttgttagctttttctctaccagttttagaatctttctgatgtgatatttttctagctttggagcttgtgaaa

SEQ ID NO: 411384 - DNA, 191 bp, Homo sapiens
tctgtagtatctctctatttgtggccatcaaaatccagtccatgcgttttttgtaaatgcgacttcatctcccagtatcagaaggagtgaaaatccagaacttttactgaacttgaatttcaatgtgaacagcaagatttgaatagaaacactttactttgacaacaattaaaattattcataccatgaca

SEQ ID NO: 411385 - DNA, 538 bp, Homo sapiens
  misc_feature (419)..(419): n is a, c, g, or t
  misc_feature (497)..(497): n is a, c, g, or t
gtctgtagatgagaattccaggaagtgtttccctgccgctcgtcagttaattgcgatcacttactcaaatggccaactggaagccagagtgcacatgaatgtcctctttgagctattttcctcctttagaatacttcatgcaggtaaccagacaatatcgagagatgcggacttctactcaacgagagagattataaatgaatcctggatgcgcttgatttcttgtttcccgcatgttgttagacctctccctaaagccacaaaacatttaacggagataatattttgagcgattctgttattgtacatatttcagaacatgacagaaaagcaaaagattaacccaaatactttagtaaaataaaagctttgagtttgtcacaaaaaaaaaaaaaaaaaaaaaaaagcggccgctcgantcgcgccggttcgacacgctgcgagagacgacagaagggctcaggcagcagcaagcggagcggatgaacgagagcgtntgacctctgagctcctcaacaagcccaggtgagatgaccca

SEQ ID NO: 411386 - DNA, 693 bp, Homo sapiens
aaggggaaaagggggcatgtactgtagcagccggagccacgacctgggccttgctccgcccctcctagaaaggccctgctccctcagcagatcacaggcaggggtgggtgtgagcctgaagtgacctcaggccctaggaagctgctcttccttcgtttacaatggaaggcaagtgagtgttgtcgcgatgtgagtgcccagcttaggatttgccctccaaagcccagtgtcttttctgtagatcaaagaaacaaatcctttaagtcctcctgttcacctgctttactggcagatgaagcctagtcatggttcaccagggggaataccaaactcgccctgcagatcggtagtaattgtgcggagatgataggaaacaggagaggcctctaccgctgaaaagcacgggtctgaaagggcaggtgcctgtcctggaaaccaccttctcttggggcatcccctggctgcccttctgcctgttgccaccaggtggggctctctcccagctcaccgttcttcctgcttaggacagcgccccacgtgacgttagtgaggcaatgcatgggaaactgcagcccaaacagactcctccctgggagaaaccccagccctgcccctgcagaccctgcaccctagacgccgttccaggccgggttcatggggatccaagaactgaggagacctcgatttacaaaa

SEQ ID NO: 411387 - DNA, 413 bp, Homo sapiens
tcaccgggaagaccacgtgcagacagagtgagaagacagccacttacaagccaaggagagaggcctcagaagaaatcagcctggtgacgccttgatcttggacttctagcctccagacctgtctaccagcaccccaccaactctcagaagatgaccttttcttctcatttcactgaaaagcagcagaaaagtacatccacatcatcatcaccaaatccatgaacctcccaacccccaaagctgtgttttccatctttcttctgtgaggtggtggagctcctacccacactctcacctgtgcttcggatacctctcaccaatatatgagtccaggagttcaagaccagcttgggcaacatggtgaaaccctgcctctacaaaaataaataaataaataactgcaaaaaattaac

SEQ ID NO: 411388 - DNA, 391 bp, Homo sapiens
gtgaatacctttgtatgtacatcattttgtgcatgtatctataaattcatagaagtggaattgcttgattaaagggtatttgcattatgatataataaactttacatgaaaaaatttcattcaggggataatgggaccaggtctgttttaggaaggtccttttggatgatgggcaggagaagaggcaagtttggagagtgctgtgattaaaccaggtgagaccgataaggggaaatagagtgaagggcaaggatgggagagacacaagtaattgatcagatgttactaataacatggcagaggagaaatcaaagacagcttggatatgcagagccccacaacggggatagactaactaagaaataggaggtgtagcttttaacattttctt

SEQ ID NO: 411389 - DNA, 944 bp, Homo sapiens
ttcaaggaacccagaagccactgggccccaaaggtggaactgaaggactgggggcagctggctctcagcctgccacctctgcactgcctgcctttaaagaaccccaccccaccccatgatggccccctctgttccccttgtatttcagtgactgtgaattgaggttaggaaggcacacctgcccttctgtgtgctctctccacacgaaggatgacagatactgtgaattcagccctcacggccaactgtgaaggggatggagaaggctgggagggctcggggagagctcttaggggctgcggaagtccccacgggggtctgagagtggagcccaagctttggccctccaggcatccccagtttccagcctcacctctgaagccctgctgcctttaaccaccagagccgcagccccctgggtttctgtctaactcgaagtcttgaatcctagctagtttggggttgtgagcagtgtgtagcaaagttgatctctccatgtcaccaaatcaaaacaccctctgtcatcctacggcatttcctcttgaggtcacagagaggaatggcaagccctggaaacctgtgttattctgtgttgatttggtgtggggggagggtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtgttcaaag

SEQ ID NO: 411390 - DNA, 490 bp, Homo sapiens
tgcagagccttccttagcaccattaggccttctacttgtgtccatttgaagcaggaggggctggatttggaaaagtctttgaagtgagagcaccacgcttgtcttcgttagaaactcttaactgcagaaaaaagttccagatggcaagggagcccttaagtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtgttcaaag

SEQ ID NO: 411391 - DNA, 361 bp, Homo sapiens
tttagaagtttcaatagcagatgaatacaagtggagacgtaaatgtgaagccagttggagtttgtgctatgcagcagtgttagccaggatctcatcagcgtgcaaacctagcatcttctgtggccacaagccacacacttgctttttttgaatgtgatgtaaaatttgtacagtaaagtttttatattttctatcaactacatttgtcttccagacatgctattaatttaaattaaaatggttagtattaacaaacatgctgtatcgggtttttttgccactggcaagaacatgccctctgtgctaagccaggcctgggtgtctggagtttgtgaataaagttataccaaggtgttcaaag

SEQ ID NO: 411392 - DNA, 442 bp, Homo sapiens
tacttggatcaaattctagagctagaccattccagaagcaccttctaccatcatttttccttgaactgccagagcttattataaaacgttcatttcgtgtttgtggcatatcctcattacagccgtgtttgaattattataagtattttctttccttttgcacagttgaaattcagttatcatgaccatattaagtgtaagccagggagaacttgcatacacaaatccttagtgatttaaactcccactgagctcttgactaatagtgtccctcactcccacctgctgctctgtggattaggaaatatcgtggaaagtgaactggagctgctgctaatttaacaaagtccactgtgtacctagccacattccctctagttctccacctattcagtgcatctcattaagccaccctcacaaatttccttttatgcttctcttt

SEQ ID NO: 411393 - DNA, 309 bp, Homo sapiens
aattatctgcacagatcactttaaggacatcagcattgtcttcctcaacatatctcccaaagccttgatgaaaagaatctctcctggacatttccagagtagatggtggttcttcccccaaattacaaggaatggaggctgggaaactacatttctgagactccttcatcatcaggatgccagataatattttaagtaaggaaaataaaattaacttttctggggcgagatgacagacgaatgtgcaaaggctttcctgttttcaagaagcagtttcttacactatgctttttattcacgttaaatgaa

SEQ ID NO: 411394 - DNA, 438 bp, Homo sapiens
aattatctgcacagatcactttaaggacatcagcattgtcttcctcaacatatctcccaaagccttgatgaaaagaatctctcctggacatttccagagtagatggtggttcttcccccaaattacaaggaatggaggctgggaaactacatttctgagactccttcatcatcaggatgccagataatattttaagtttttattgctgctgcagtcaaaatgtggactttgattgacattttccaggaagagaattgtgagaagaataattggatattctgtaacattgttctaagaactgttagctctgttgcattttcttggtttgacattttgcaaaatcctactgtcttcatttgcaaggtagaatggaaagtttatggagacttgggcaactttcctatgaaatctgccaattaaataaacaattgagattgg

SEQ ID NO: 411395 - DNA, 386 bp, Homo sapiens
cacctggattttgaagggttttgtgtcgtttaactgctcatcagagctctccacacactgaaacctcaattctcttgttgagacactagaagtctgcgggtgcccctcacacaggagaaatgcaagctgcccccttgaaaaacgtcctcagagttgcaaccacaggggccaagtcaagaacacttcaaagactggatgcaatccagccaagaggttggctccttccctcagccagatctcccatgtgctaccataaggagagcctcgcagagctgtggcaggtggtattggcatggatgagaaacttctgcatgggtcttagtgaatgcattggcattcctggatgaaatacattaaaaatgaaataaatccatattaataacaaa

SEQ ID NO: 411396 - DNA, 607 bp, Homo sapiens
agaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctcccggcgaagacgcctcgccggaggagctgaaccgctactacgcctccctgcgccactacctcaacctggtcacccggcagcggtatgggaaaagagacggcccggacaggcttctttccaaaacgttcttccccgacggcgaggaccgccccgtcaggtcgcggtcggagggcccagacctgtggtgaggacccctgaggcctcctgggagatctgccaaccacgcccacgtcatttgcatacgcactcccgaccccagaaacccggattctgcctcccgacggcggcgtctgggcagggttcgggtgcggccctccgcccgcgtctcggtgcccccgccccctgggctggagggctgtgtgtggtccttccctggtcccaaaataaagagcaaattccacagaaacgga

SEQ ID NO: 411397 - DNA, 735 bp, Homo sapiens
  misc_feature (428)..(428): n is a, c, g, or t
agaggaggcctcagcttgacctgcggcagtgcagcccttgggacttccctcgccttccacctcctgctcgtctgcttcacaagctatcgctatggtgttcgtgcgcaggccgtggcccgccttgaccacagtgcttctggccctgctcgtctgcctaggggcgctggtcgacgcctaccccatcaaacccgaggctcccggcgaagacgcctcgccggaggagctgaaccgctactacgcctccctgcgccactacctcaacctggtcacccggcagcggtatgggaaaagagacggcccggacaggcttctttccaaaacgttcttccccgacggcgaggaccgccccgtcaggtcgcggtaaaagcgcccgttaccacacatcctgcatccgagagcgcggcctggccctaccctggcaacatcanttaacgacgtctcccaggctcgcctccccagatccaattccttccccttcgcttccgcaggtcggagggcccagacctgtggtgaggacccctgaggcctcctgggagatctgccaaccacgcccacgtcatttgcatacgcactcccgaccccagaaacccggattctgcctcccgacggcggcgtctgggcagggttcgggtgcggccctccgcccgcgtctcggtgcccccgccccctgggctggagggctgtgtgtggtccttccctggtcccaaaataaagagcaaattccacagaaacgga

SEQ ID NO: 411398 - DNA, 314 bp, Homo sapiens
ggggtaaggtgcagcacacagaaaccctggcagggaattcagaatgggtgggagtctggacccagtttcgcctgatgctaacttgctatgactgacctttagccagtccacttctgtgtcttcatttgcaccaggaaagagtggactacgcttgctactcaaagtgtgacccaaggaccagtactatgggtatcacctggaagcttgttagagccacaggcctcaccccagagcttatgaatcagaatctgcatgttaacaagattcccaggggatttatatgcacattaaagtgtgaaaagccctaggttaaa

SEQ ID NO: 411399 - DNA, 279 bp, Homo sapiens
tactttctgggagacacagatcccctcctggaagaggcccatgaccacacggcaggagttcctttccgagactgccaagcacctgtagcagtgcagaccctgagctctcttcatgcacagcagggccatcagcaggaccagggcaaaggtcttcatggcataggaactgctcattcttcctctcttgccagtcatttagtttcaataaactaaaatttgttcttagttttgtagcttaaaaaaaaactacaaataagccagtgcaatttccacaaccat

SEQ ID NO: 411400 - DNA, 420 bp, Homo sapiens
gcctctggatgacattcactttgtgcaaagccccccccgtccccccgcccccgcccaccccattacagtaagtctcaacagatctgctattctgctctctggaatctacaggatacacctagccttgattccacaggagaatacttcaatttacctgggtacatattaactccatcagcttttcttcatccattaggaaagctctcaggaggagatttactttgccaacatctctctcaaaccctgatgccaagaattgaattcaaggtttcacccaagtgacaaactagaaagatgtttaatggctttgttgtaattactgtatttccctaagtatatccttggagcttccatggcagcaatattacccagctgactccatattacaatctaccaaataaaaccttaaagtgttaaaaa

SEQ ID NO: 411401 - DNA, 466 bp, Homo sapiens
aacggatgtgacttctccccaacttggctaatggggatttactttgtctttttacacccgtgagaatgttcggggtcccagagttccttcctcactcttccaacaggttccatgatttgggggcgcctctgccgcaggccctttctacctgagtgttctctcttctgcaacacccgttttaaccccttttaaaggaattgggggctagccagactagactaggggcggcgaaacgcactgaagagagttggatacagaatttcttgcaaacgaggtcgagttgcgtctgggatacggtgtcatgccccacccccgccccacgaccctgccggccccacctttcttttgcttcgcctgcagaaacccgcacggccttcatacgtgcatttgaaattacctaagggcgtaagcaatatttcctctgtcacggattaaaactttcgatgtaacggtgttaaaaaaaaaa

SEQ ID NO: 411402 - DNA, 475 bp, Homo sapiens
gagtttagctgtcactttacttgaggggtataccctaacttccatagagttaggtatttttgctatgtactcttagctgtcctgcacttccctcacggcatttatcacatgtatcttaattgcttctttgccatccctactaagcgagactgtcggtgagggactgtgtttgtctcgtttatctttgtaactccagtagctaatacagttcttggcacataagacagtcagttatttcttgaatgattgcaggtgctgaaggtatgctgcagagatcaggcagttaacgttaatgaatacttcacccttagaaggggtcacctgccactcagctacagctgattgtggctatgtgagaatatgatcccagttttgccagaacatctaattttttcaaaaaaagttggaaataccattttttaaaaagcatcctctcccagtttttaaatgttgtcagtggaatagaattttatta

SEQ ID NO: 411403 - DNA, 468 bp, Homo sapiens
ctgtagatcccgaagggctcctcgggggcagctgccggctgacctcacctgctggttccaccagtgcgcgcccacgaaaccggcaaaatgtcccaactgcagtatctctccgctggctgatagctccccgggcaaaaatgaaaccttgccagaatagcggaagctccgctaaagcctcccatgccccctcatctcttcagaagtcacacggatcacgactcttcagaagtccacagatccccgtggactgacctagctatcatatctgtatcatttacatgtattaatctatctctgtgtatgtaacactttatgtaaatagagtattggcgtctgtcttttgctcaatatggtttatgcaatttatgtttttgcatatatatttttcatctctgtggaatagtccattgtatgaatacaccaccactgatctattctaaagaatgaatatattctgctgataataac

SEQ ID NO: 411404 - DNA, 455 bp, Homo sapiens
ccatactgcgctgctccacggggccgccgcgcctcagccgcgccgctcgctgctcctagccgattggcttggcaggcgcgtgggcgggtgttatactggcgacttattggtccgcaaacacatcctttcccattggagaaatgatgcgccgatcctttcctacctcttcctagacgtggcccagtccggcttctctgtggttgccgcgagaggcggggctccacgggccacgccgttgctcctgctccacgctggagcggggtgggcgctgtctccgccgctgacttggggccgccagggcgcgggccgcggaaggctctgcctcgtacttcccttgaggtcttatctcttcttacagatctctccgctggctgatagctccccgggcaaaaatgaaaccttgccagaatagcggaagctccgctaaagcctcccatgccccctcatctcttcag

SEQ ID NO: 411405 - DNA, 1356 bp, Homo sapiens
cagagtgagactctgtctcaaaacaagcataggaataagtatagtgtaaccccattggtttttagaaggggccaacctctgtaaaattctagggatgatcgaagtatggttctgttctttttgtctggatccagttcagcatcaggatgaatttaaagccagagcaccacaatgttgatttctatttagctcttaagccattttaatttcagtgtttttttttctagagcatggcatacatccattaattgtataaaagagatgaagaaggttgaaagagaaaggcaatgaattaaggaatagcaattggtaaataataaggttctagagaggaagtatgcattcaatttgctttgcagaacaaaaccaattttaggcagggaagaaaggaaaagttttaaaagaaagctaacagaaccaagtgatttattgttataattcgatataccctaatgattgtggcttgtttctacattcgttataaagtagttcagatatcatggccctgtattttcattctgttctcaagacccattgctttcttgtgaactttgggactgagataacagtacagtagatgggggtggggggttggaggtaggggtaattaaagagagtagtctcttagtagctgtgtgagccccagagtggatcgcaagtgacttgtagctgggcagacataactatatgaacagattggttgtggctgtgttttatggtcaattctgtccttccctgtatttcacaggttgaagcaacagtgttaagaagagaaactcttaactcttaacacagtgtgaagaaaaatggaacagtagtgggcaaaactgtggtttataagtgtgttcattctccatcattcggtttccagcttccttaacttttattcctcctttgctctatcctcacagaattgctggaatccacaaataccaaactatggccattgaagctgaccttggagggggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaatttcctaaaactaaacatcaatcattgcaggagttgttggtattaggagcaaagtagactaactacaacatcaatgccaacaagagcatctgccggttactgagcacttactaagtgccaagcactattttaagtgttttccttacattatctcatttatgctccacaacaacctaattaaataaccatgaattttatccccc

SEQ ID NO: 411406 - DNA, 723 bp, Homo sapiens
agcggggcggggccgaggcggcgagtgtctgggcgagcgtggctgggcccggtcctgggctgggggcaggggctagggccgggtcccggggtgagccgaaacctgggggtcgggcggggcgggaaatggggcgcagtgaggctgggagccggccctgagctcgtcctgcgtaggggtagccgggctcagggggcgcctgagctggaggtggaagcgtgaagtcaggactgagtgggcgaagagaacctgggctgagacatggccgcttaccaacaagaagggcagatgcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgacttattttttgcttcccaaactccattgtctcattctcactgcttatgttattgctcttattatttcagctgcataaatcagaaagaactcca

SEQ ID NO: 411407 - DNA, 609 bp, Homo sapiens
agcggggcggggccgaggcggcgagtgtctgggcgagcgtggctgggcccggtcctgggctgggggcaggggctagggccgggtcccgggacatggccgcttaccaacaagaagggcagatgcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtgtatcctttcatgtcactcatttttatcctggctgttgatcatctgcctaatgacttattttttgcttcccaaactccattgtctcattctcactgcttatgttattgctcttattatttcagctgcataaatcagaaagaactccactctgtatgtttccttaagagacaacaggtcctctcttcaaaaacttcatca

SEQ ID NO: 411408 - DNA, 863 bp, Homo sapiens
agcggggcggggccgaggcggcgagtgtctgggcgagcgtggctgggcccggtcctgggctgggggcaggggctagggccgggtcccggggtgagccgaaacctgggggtcgggcggggcgggaaatggggcgcagtgaggctgggagccggccctgagctcgtcctgcgtaggggtagccgggctcagggggcgcctgagctggaggtggaagcgtgaagtcaggactgagtgggcgaagagaacctgggctgagacatggccgcttaccaacaagaagggcagatgcagcttccccgagctgatgccattcgttcacgtctcatcgatactttctctctcatcgagcatttgcaaggcttgagccaagctgtgctgcgacacactatcaggagttacttgatccttcccgccagaagaaacttatgttgggagatcaacaccagctagtgggcgtctctataaagcctcaacgtatagaacagatttcacatgcccagaggctgttgagcaggcttcatgtgcgctgcagtcagaggccacctctttctttgtgggccggatgggtccttgagtaattgctggaatccacaaataccaaactatggccattgaagctgaccttggagggggcagcttggtttatcttgcttattttcatcctggagatccttcttaagtggctatccaacttttctgttttctggaagagtgcctggaatgtctttgactttgttgttaccatgttggtaaggatagagatcctgagggttcgtttagtgggatgaagaatgtgcctaggtgaatcgaaagaacaagttaacatgataataggaagaaacaaaaatttacttaacttcttt

SEQ ID NO: 411409 - DNA, 617 bp, Homo sapiens
ggagccggccctgagctcgtcctgcgtaggggtagccgggctcagggggcgcctgagctggaggtggaagcgtgaagtcaggactgagtgggcgaagagaacctgggctgaggtgaggcccagaagcgagaatggaggagagaaggagctagcccccgaaggagtgttggagtggacacacttgggacgggacccattttcaaaatgtcaggctttggcattttgtccaatttctcttcacttggtttctcttgcgtgggcaggccaagccctcccccaactccacctcattgcccgattctctcaggcccaggtgggacccaggttcttctttgtccagccccgggcccctgcccttgtggctgctccttttttattgagtttcttgttttgttttgttttgttttgtctgagatgccgtcttgctctgtcccccacgctggagtgcagtggcgcgatctccgctcactgcaagctctgcctcccgggttcacgccattctcctgcctcagcttcccgagtagctgggcctacaggcgcccgccaccacgcccggctaattttttgtatttttagtagagaccgggtttcaccgtgttagccaggatggtctctat

SEQ ID NO: 411410 - DNA, 833 bp, Homo sapiens
ggctacaaacagcaaactgtttatcatgaatgcaggatgtgggcaaactcacactgccctgccaccaaaaggtttgctaacagacatcactccctagctccgggctccttaaagttatctgcctaaaaaatctagtgcctattgtccaaaaaatgcaagactactgtgaaccaaacggcagactgacaatcacccccctcccccagctttctcgctatctctttttgcctaataaatacggagggctgtgtaaagctcagggcccttgtccactaaaggcaaggtgcccctaaccccttcttccaaatatactctgttgtctcttgtcttttattcccgtgttgcccgcctttgttcagtccagtaggtccccaacaatgtcctgagggtatgaatcctgaaagactactctccatgaagcaggtatttaccaggttagtgcatgtttcctgggtattaagggaaaacagtaaaatgttctgtacgggggtcccggttctgtgtcgcacgagaagagtgtgtgtctttttacttttttaatatggctcaataaaattttaaatcacaaaaaaaaagtaataagaagaaaaagacaaaaagcagaagacaaaacaaaagaaggggaggcgggccgcccaccaaaaagattcccccccggaagggagccccagcataatgtgcgcagcaccccaagtcttcttgtgacaccaaggggggcccccaatataagaggaccgcatttataaaaacacagggcacggggccgcggtgttacacacagcggctggacgtgaaaacagcgcggtcgggggcgaaccgtggaagagaaccct

SEQ ID NO: 411411 - DNA, 360 bp, Homo sapiens
gactattacagaattttaggaattctataaaactgtagaaaatgcctgataattactaaataaatattggatttgattcttctaagtgattgtttgtttttaaaaattcaagtttttgaaaataatcatttatatataaccaagaattagtcctgtttagcttctaaaaattaatttcagtaccaccgagataaaaagatatgtgaaagaatatttgtcaccaaaatactcaaaagagttaaggggaaaatggaaaattttaattggtctttggccaaaggttaatacattcagaaatatagaatgggtatatcgcgccttaaatattctttcaatcattgcctaggttttcttgcttag

SEQ ID NO: 411412 - DNA, 1904 bp, Homo sapiens
gagggctcagccttcccaccagccctggagaggaggaagggactgactacgccagcaagctctggagctcagcagtggcaaagatgagatctccttgttggtggaacaggagttcctaagcctcaccaaagagcactcgatcctggtcgaagagagttctggggagctggaggtacccggcagctctcccgaggggaccagagagctggctccctgcattcttgcccctcctctagtggcaggcagtaatgagcgccccagagcctccatcattgtcggagacaagcttctgaagcagaaggtggccatgcccgttatcagcagcaggcaggactgtgattctgccacttctactgtcacagacattctgtgtgccgccgaggtcaagagcagcaaggggacagaggacagaggccgcatcctaggtgactccaacttggaagtcagcaagcttctgtcccagttcccactgaagtccactgagacatccaaggtccctgacaacaagaatgtgctggacaagacaagggtcaccaaggacttcctacaggacaacctgttcagtggccctggacccaaggagcccacagggctgagcccatttctgctgctgcctccccgacctcctcctgcacgtcctgagaagctccctgagctccctgctcagaagaggcagctcccagtgtttgccaagatctgttccaagcccaaggctgaccctgctgtggagaggcaccacttgatggaatggagccctggcaccaaggagccaaaaaagggtcaagggagcctctttctcagccagtggccccagagccagaaggacgcctgtggtgaggagggttgctgtgacgcagtgggcaccgcatcactgaccctgccgcccaagaaacctacatgtccagccgagaagaacttgctctatgagttccttggggccaccaagaacccaagcgggcagccgagacttcgaaacaaagtggaagtggatgggccggagctgaaatttaacgcacctgtgacggttgctgacaagaacaacccgaagtacacagggaatgttttcactccacactttcctacagccatgacctcagcaaccctgaaccagccactctggctcaacctgaactatccacctccaccagtgttcacgaatcactctaccttcttgcagtatcagggcctgtacccacagcaggcagcgaggatgccctatcagcaggctttgcacccgcagctgggatgttactcccaacaggtgatgccatacaacccacagcagatgggacagcagatcttccgctcttcctacacccctctgctgagctacatcccttttgtccagcccaattatccctaccctcagaggacacctccaaagatgtctgccaacccccgagaccctcccctaatggcaggagatggaccgcagtacctctttccccaaggatatgggttcggctcgacatccggagggcccttgatgcacagcccctatttttcttccagtgggaatggcataaacttttagatctcctcttctcccttctcctcccttagcccttggatcaggactaggggctctgatttttggattctgcaaaagcttggtatgaagtttggaaaagcaaagttctgaccaggtcacagacaaaacagcaagaccagattcatctattggccaacactgacacaaaaatagccctcctcacacatggcacaagctacacacacacacacacacatgaccctcatattcatacttgcttgctcaaccacttatgcatctgtatttagctaacatgagtgatttttgtttttgtttttgttggtaaaatagaagtaagacacttaattttagaaagtttgtattttatgataaaagtatgagctacttgaaa

SEQ ID NO: 411413 - DNA, 523 bp, Homo sapiens
taaataaagtaatatacatttattgctttcacacaatagtccaaaagatatgacaataaataatatgagtgaaatatatatgatacattgaagatgtgtaaggtctaacattaaacaattgaattctaggttaagaacacgaaaaaccaaggacaggaaataatcgtggaaataatcattgataaaaatttctgagtgctgaaggaaaatagttttcgaattgagaaaattttctaagtgtccaacctcaaataggaaacataaacacacataaactcgcacctggaggcaatgttcaaaacacaaacccaaataaacacatactcggagacagtgttctaaataattagactacattcataaaaataagattataaacactagagaaagagaagatgaaaataaaaagggaaaaaagaggctctttaccaacaaagaaaatataatcagacggataccaagtccactcttggtttctagaagataatgaatacaatttcagatgcaaatgtataaattcctt

SEQ ID NO: 411414 - DNA, 316 bp, Homo sapiens
gtattctaagcacaagttctttagctcttcgggcccaactcctttaaggatctcatcacagggactgcttccctgttcataaatacccataaacatgtctttgtgaactctcagaacctcactgacctgaagcccattcttaggctttggatcttagggtaagaatcactgccggaaaaacttttttaggccaggcacggtggctcttgcctgtaatcatagcactttgagaggctgaggtaggtggatggcttgagttcaagaccagcctaggcaacatggtgaaaccctgtctctactaaaaatacaaagatta

SEQ ID NO: 411415 - DNA, 800 bp, Homo sapiens
tttcagactcagcccacctgcacccaggtgaaataaacagccatgttgctcacacaaagcctgtttggtggtctcttcacatggacgcgcatgaaatttggtgccgtgactcggatcgggggacctcccttgggagatcaatcccccgtcctcctgctctttgctccgtgagaaagatccacttacaacctcaggtcctcagaccaaccagcccaagaaacatctcaccaatttcaaatccagaccagaaaatctttctcttccagtcagtgtcattcatttatgaccagcggttgaatccagtcataaaatctgaagctcctgggtacctctacatcactgggcctatgatacactgtttcagaacgtacttacacatggggtgggacgattttcttaactaatacttgtgactactccacagcaaagctggaaacaaaagtattgggtgagctatcttccaaaatctggagatggtttcggagagagtttcattgccataaatttaaagggggattggatttactcaggaaaaattgcaagtgagcgtaggagataaactagtaaatgtcatatttggcccaccaggcacaaagaagggttataattggctcctttaagtcctatatgcagatatcaaatccctatacttgctctttattgcatagaataaatttacctcactccttactttgaaacatgaaatgaggatcaaattatagtttcaattattgcaaatagttgtacaaatgaaaagattgtcttattgtgggcattacacaaacccaccaaggaataag

SEQ ID NO: 411416 - DNA, 633 bp, Homo sapiens
cctttatgggagaaacgggctaaggaggtctctcttggcactgagctgtgacaccttgggggagaaaaagtgcaggaccagaaaatctttctcttccagtcagtgtcattcatttatgaccagcggttgaatccagtcataaaatctgaagctcctgggtacctctacatcactgggcctatgatacactgtttcagaacgtacttacacatggggtgggacgattttcttaactaatacttgtgactactccacagcaaagctggaaacaaaagtattgggtgagctatcttccaaaatctggagatggtttcggagagagtttcattgccataaatttaaagggggattggatttactcaggaaaaattgcaagtgagcgtaggagataaactagtaaatgtcatatttggcccaccaggcacaaagaagggttataattggctcctttaagtcctatatgcagatatcaaatccctatacttgctctttattgcatagaataaatttacctcactccttactttgaaacatgaaatgaggatcaaattatagtttcaattattgcaaatagttgtacaaatgaaaagattgtcttattgtgggcattacacaaacccaccaaggaataag

SEQ ID NO: 411417 - DNA, 478 bp, Homo sapiens
gcatatgtggtcgctgattatttatgttggctttttctttcataaatcatagagcagaatatcctttgtgatttttagtttggatgtctttaaactctgtaaggttaaaatatgcttttattttttcagaagtaacagatctaatggaaagaattgggaaaatacagtaaaatgatctgatacattcttaatcagaaattcacatagttgatattggaagtagtgcattttcatcaggatgaaaggagaaagaagcagaaatttttttgttgttttgttttgtgagtatcaagtctatgaatgacacagccttgtattttggcagagaggaaagatgagtgatgggcagcccagctcttccaatgactccattctcatatgctaataaagagcatctgtaaaattcagacattctttgctcatggttttatctgtcagaagttagaaaaaataatgatagcaaagactttaaaataaa

SEQ ID NO: 411418 - DNA, 346 bp, Homo sapiens
gcttttctgttttaagatcatttattagaacacagtcattcagaagccattgagacatcaggcagcaggaaggaagctggggcggagcaggccctgggaaggaccaaggacaaagtaatagccacagtaatgacatttcattttattctgataaagactaatgtatgcctgataacctagtgagaatccataagtttggcagttcacaacatttttagaaagcacatacgattaacattcaaataaggcattatagaaagttttgtaaagaatgaagtgtttactgtcattcttttaaaaaaccttggctcatcttgaaagatcaatgaatttttaaaatatcaga

SEQ ID NO: 411419 - DNA, 1455 bp, Homo sapiens
tggtgactcctggtctccatgtcatctgccagaaaggccacctgcgccagcacctcctgagaccggccttcaaagacacgacgcatgccgctctgccgtccggagcacttaatgcctagagccagcagggtcccagtggccgcgtcactgcctctgagccacgcggtcattccaactcaactgccctcgcgttctggccacaggccccctgggagaccccggagatgcccaaaggcctcatgcctgccgcctccagtgggacctagcagcacacagacagcgaagcgggtgaccatggggtggccacggccgggccgagccctcgtggcagtcaaagccttgctggtcttgtcgctgctccaggtgcccgcgcaggcggtggtacgggccgtgctggaagacaactcgagctcggtggactttgcggatctgccggcgctgttcggcgtccccctggcccccgagggcatacggggctacctgatggaggtcaagccagccaacgcgtgccatcccatcgaggccccgcgactgggcaaccgctctctgggctccatcgcgctgatccgccgctacgactgcaccttcgacctcaaggtgctgaacgcccagcgcgccggcttcgaggcggccatcgtgcacaacgtccactccgacgacctcgtgagcatgacccacgtctacgaggacttgaggggccagatcgccatcccctcagtgttcgtgagcgaggccgcctcgcaggacctgcgggtcatcctgggctgcaacaagtcggcccacgcgctgctcctgcccgacgacccaccgtgccacgacctgggctgtcaccccgtgctgaccgtgtcctgggtgctgggctgtaccctggccctggtcgtatcagccttctttgtcctgaaccacctgtggctctgggcccaggcctgctgcagccacagacggccggtgaagacgtctacctgccagaaggcccaggtccgcaccttcacgtggcacaacgacctgtgtgccatctgcctggatgagtatgaggagggcgaccaactcaagatcctgccctgctcccacacctaccactgcaaatgcattgacccctggttctcccaagccccccggcgctcctgccccgtgtgcaaacagtcggtggccgccacagaagacagctttgactccaccacctacagcttcagggacgaggacccctccctaccgggccaccggccccccatttgggccattcaagtccagctacgctcccggaggctggagctgctgggccgcgccagtccccactgccactgcagcaccacgtccctggaggcagagtataccactgtctcctcagcccctcctgaggcccctggtcagtaaagatctagggcagggaggggggtgcaatgaggaatgtttctggtctgaaaagaataaagtgggtttgaaagcggaaactca

SEQ ID NO: 411420 - DNA, 424 bp, Homo sapiens
aagaatactaagtcacccaacaaatttcggcatgtaaacaaaaagtaatccaaaggatggagtaactttgttataacaaaatttcagtgtccatctacctttttatagggataagttttctcagtaattaagtcagatgtaaatctttttttttaaaaaaaagaaggaagccaggcatggtggtgggcactggtattcccagatactggagaggctgaggcaggaggaccaattgagcccaggagatcaagtccagcctgggcaacattagtgagactgccatctctttaaaaaagaaagaaaaagaaaaaggaaaagaacaaatagacgtaatttgcatccggaagtagatgggcttattggaagaaaagtcccatccccctcgttaagcagtgcattttcaataaaaatatttttctttagt

SEQ ID NO: 411421 - DNA, 436 bp, Homo sapiens
cctcctcaagccagccagggtgctcaactatccagagtccaaacaaacttggtgaattctcaccttgtactcttccacactctgcctgggatgtcctgttcctgctcatcctcctctctgaatcctactgatgttttagtgcaagccttcatcccctaagtctcaccttctctgggaagtctcccctccaaccaaccagaaatagactttccatctctggagttctgtagtgcttactcttcaaagtaattaatgcttaaattaacttgtgtcttaccactcctttggcatttatcatgtattgccttttattgacatttattctcccaattcattctaagcttcttaagtagagatacttttcctggtatctaaaacagtaccttgcacaccctccaaaaaattattaattaatttaatgtttttctgtaattcc

SEQ ID NO: 411422 - DNA, 360 bp, Homo sapiens
cctcagagtacttttaagaacaaggaggtctctgcccacggcagcccaagcagattcccatccatcatgactgccatccgactacgagaatttattgagcgtcgcccagtgatcccgccaagtatattcatcgctcaccaaggaagagacgttcaaggctattaccctgggcagctggcaagactccattttgatcatagtgcaaagagagctcccagattggaaccagaaattagccacagtttcgctgaatcctcgaccgcttaattcactgccagagctctactgttgtgaagagagaagcagctttgaaagaaatgcttttaaactaaaataaccacggcattcgaacaaaaaacg

SEQ ID NO: 411423 - DNA, 335 bp, Homo sapiens
ctcctcactttctgctctagtatattcatcgctcaccaaggaagagacgttcaaggctattaccctgggcagctggcaagactccattttgatcatagtgcaaagagagctcccagacattcaaagcctgccgagccatggtataaagaaaccacttaccgacgagactattctctgccattttatgagattgattggaaccagaaattagccacagtttcgctgaatcctcgaccgcttaattcactgccagagctctactgttgtgaagagagaagcagctttgaaagaaatgcttttaaactaaaataaccacggcattcgaacaaaaaacg

SEQ ID NO: 411424 - DNA, 1817 bp, Homo sapiens
ctgttggccacagtgcttgcacatggccttgccatgtggcatgggcacagcatggtacctggattctacagagaatgccctaacagtaaatgttccaagagctcaaaaccacaaagcttctcataactcaatgtggaaattaggcagtcacttctactgcattctattggttacaaaggacccacctgggttcacaatggtatgagtactgggaggcatggttcattgaggaccatctttgtcgacttgctatcacaggcacaaaatcgtttcaaaaacacatatttttaaaattccctctcctcttggctcataggtcaatgggaaagctgtctgagacaatatgaaaatcaatgatgccactctagcattagctgaagatccccttgatttcatccagcagccaagacactaagtgacccaaaggaagaaaagggtgatcagcgtggctgtgtggtcagtaagtaaatgtgcaacagctggagtaaattagaactaatttagtgcataacttcagcaggaataaattttgttaatcttcaaaaagtcaaaacaaggattgtaactttcacagtatctgaatcacccaaattttactacaagactcttgtcctcattgttgcacttaccagttccgtactgataataaagaaaaattactattgaccttttcctaacaaagaacaatttttaaaattttgtttttacaataggaccctatggagctgttgttttaatattatgtaaattaagtaattttatctactctaaacaaattgctttatcagttgtagtcgaatctgactactcttatgcttattttattattaatccaagtaaatattctctattgaacatagattagcagtttacaaattagataaaaacagaaaacaaatcacttcaacagtattaactagaaatatgctagctactccttatttcagaataaggtgtcacaattcttccttttaaaatgttgtattgtatcatacttaaaaatatataaataattcctgaataaaagcatccaatatttatcattttattagtattagcctttgggaaaaaatttgatagcatgattttataaagctcttgcatttgctttaaatttagctaactattttgaccacaaggtggagctgtgatgtcacaatttggcaagatttgtaagatacaaaaactatgtaaatacagacgaaaataatttaataaaataggataatctcatcttgcaaatatgcactatttaaaattaatcaattctccaaacattaattatcagaagaaaactatcatttaatttgtccagttctcacttagcagttattgagctttatcatatataaattgtcttcagtagatgcagaattattctgtcatttcacatcacgatcccagatttagtgactttaaaccagtgttaaaatgtctttcaaaattattttgtaattaatcacagaataattcattaaccattacaaaatgtaatggttacattacatccttattttgttatccaatattgactagaggatcatccattatatcttctaaaataattctttcagttgattatttgtgttttgtattgttaaacaggcagaaacttctaattttcaaaagagagtattcagattttgagtcaaccaaatttcagtgaagatagactagcatgctaaactcatcgtctcttgaattattaaataaacaaacattaccaccacttcaataatatctgtcaggaatgaaaccacttttccaaatgaatgtttcctgatctattttaatatattaagaataaaacaaaaaaa

SEQ ID NO: 411425 - DNA, 638 bp, Homo sapiens
ttttttggctacctcttaaattcaaaacacctattccccctcagggatcattttgattcaaatacaataaaatttcagatataaaaccaacttccagttaacacacaaatacctactatatgccagactatatgctaaaactgaaaaggtggaataagacccagtccttgccctcaaggagcccacggccttattgaggagaatgaaaggtcaatgggaaagctgtctgagacaatatgaaaatcaatgatgccactctagcattagctgaagatccccttgatttcatccagcagccaagacactaagtgacccaaaggaagaaaagggtgatcagcgtggctgtgtgcctactcagcgcgaagacaacaaggatgaaaacctttatgatgatccacttccacttaatgaatactgcccagaatacgaatgcaacgactgaaactcaagtagcaattttggacaaggaagtaagattaaaactggggagccttttggaccaattggtgggagtaacaaaagagctatccctcttgacagcataaagcctccctaacagccttgtgctccctacttcttaattactttcaatgtgaaagaaggaaaaaacttaaataaaacatatttcttatttaaaa

SEQ ID NO: 411426 - DNA, 1710 bp, Homo sapiens
ttttttggctacctcttaaattcaaaacacctattccccctcagggatcattttgattcaaatacaataaaatttcagatataaaaccaacttccagttaacacacaaatacctactatatgccagactatatgctaaaactgaaaaggtggaataagacccagtccttgccctcaaggagcccacggccttattgaggagaatgaaaggtcaatgggaaagctgtctgagacaatatgaaaatcaatgatgccactctagcattagctgaagatccccttgatttcatccagcagccaagacactaagtgacccaaaggaagaaaagggtgatcagcgtggctgtgtggtcagtaagtaaatgtgcaacagctggagtaaattagaactaatttagtgcataacttcagcaggaataaattttgttaatcttcaaaaagtcaaaacaaggattgtaactttcacagtatctgaatcacccaaattttactacaagactcttgtcctcattgttgcacttaccagttccgtactgataataaagaaaaattactattgaccttttcctaacaaagaacaatttttaaaattttgtttttacaataggaccctatggagctgttgttttaatattatgtaaattaagtaattttatctactctaaacaaattgctttatcagttgtagtcgaatctgactactcttatgcttattttattattaatccaagtaaatattctctattgaacatagattagcagtttacaaattagataaaaacagaaaacaaatcacttcaacagtattaactagaaatatgctagctactccttatttcagaataaggtgtcacaattcttccttttaaaatgttgtattgtatcatacttaaaaatatataaataattcctgaataaaagcatccaatatttatcattttattagtattagcctttgggaaaaaatttgatagcatgattttataaagctcttgcatttgctttaaatttagctaactattttgaccacaaggtggagctgtgatgtcacaatttggcaagatttgtaagatacaaaaactatgtaaatacagacgaaaataatttaataaaataggataatctcatcttgcaaatatgcactatttaaaattaatcaattctccaaacattaattatcagaagaaaactatcatttaatttgtccagttctcacttagcagttattgagctttatcatatataaattgtcttcagtagatgcagaattattctgtcatttcacatcacgatcccagatttagtgactttaaaccagtgttaaaatgtctttcaaaattattttgtaattaatcacagaataattcattaaccattacaaaatgtaatggttacattacatccttattttgttatccaatattgactagaggatcatccattatatcttctaaaataattctttcagttgattatttgtgttttgtattgttaaacaggcagaaacttctaattttcaaaagagagtattcagattttgagtcaaccaaatttcagtgaagatagactagcatgctaaactcatcgtctcttgaattattaaataaacaaacattaccaccacttcaataatatctgtcaggaatgaaaccacttttccaaatgaatgtttcctgatctattttaatatattaagaataaaacaaaaaaa

SEQ ID NO: 411427 - DNA, 493 bp, Homo sapiens
ttttttggctacctcttaaattcaaaacacctattccccctcagggatcattttgattcaaatacaataaaatttcagatataaaaccaacttccagttaacacacaaatacctactatatgccagactatatgctaaaactgaaaaggtggaataagacccagtccttgccctcaaggagcccacggccttattgaggagaatgaaaggtcaatgggaaagctgtctgagacaatatgaaaatcaatgatgccactctagcattagctgaagatccccttgatttcatccagcagccaagacactaagtgacccaaaggaagaaaagggtgatcagcgtggctgtgtgcctactcagcgcgaagacaacaaggatgaaaacctttatgatgatccacttccacttaatgaatagtaaatatattttatctttctttataattttttaaataacgttttctctagcttattgtaacaatacagtgtataatgc

SEQ ID NO: 411428 - DNA, 520 bp, Homo sapiens
taggagggtttgggctccagacacctattgtttcattctccacggtgcaggagatggagacgttgcctatgagtgagaagtaggggttgcagctgtaggtgacagaggaggcatatgtgtagaattcttgatctccaccgctgtgcttcccattcctgatgtctggagggggctcgcacttggcaactgaggctttttccacaaccatcgaaggctactttgatttgcaattagcaggataaactgaagataacaccttgcagaagcagatctcaattaacaactgatggaatcaacagatggaaccatacagaaaaggcagctgtagaagagttcatctgtatcctggccatatggccttgacctactctagagccattctgctggatgtgaagtggtatctgattgttactagaaggctatccttacaagaaatgctaaaggaaattgttcagactgaaagcaattgacaccagacggtaatttgaatccacacagtaaaacaatgagcatcagcaga

SEQ ID NO: 411429 - DNA, 813 bp, Homo sapiens
taggagggtttgggctccagacacctattgtttcattctccacggtgcaggagatggagacgttgcctatgagtgagaagtaggggttgcagctgtaggtgacagaggaggcatatgtgtagaattcttgatctccaccgctgtgcttcccattcctgatgtctggagggggctcgcacttggcaactgaggctttttccacaaccatcgaaggctactttgatttgcaattagcaggataaactgaagataacaccttgcagaagcagatctcaattaacaactgatggaatcaacagatggaaccatacagaaaaggcagctgtagaagagttcatctgtatcctggccatatggccttgacctactctagagccattctgctggatgtgaagtggtatctgattgttactagaaggctatccttacaagaaatgctaaaggaaattgttcagactgaaagcaattgacaccagacggtaatttgaatccacacagtaaaacaatgagcatcagcagaggtcattatgtcagtaatttgaaccacagtataatatatattactactccttccttctcttagctgatttaaacagcaattgcataaaacaatatgtatataattgcattattaagcctataacatacagaaatgcaatatatttgacaataacatcacaagaaaggtaggagggaacaaagctgtattatagtacagaaatgacaccagatggtaacttgaatctacaggaagaaataaagagcgccagaaatgaagaataagaagattaacataataaactctctaaatat

SEQ ID NO: 411430 - DNA, 499 bp, Homo sapiens
tgtagacatatatgcatactccttagctctatgcaccaagacagtttggaaatggtcatactctaatagcagttaacacccctagtcccaaatcttggtctctaaataccgttctccactaaaagaaaccagggatccttggagaaatgattgatttcagggctgagacaaggaaagtacaagatgaactcagaccatcttgctgtggcagaaagtaaagaagtgcttaaagaatgacagagatatgtcaacaggatgtcaaaggggcttgaagggggctcccctaaccaactctgagcatcaaaataaataatgacagtaaaaggtcataatctatcaaatgaagtaggaatccacatgttcatactgatatgaataaaagaatacataaacaaatgagaacatttttctttacagcagaataacaataaatttagaaggaacaatgaaattgaaaaaaccactattaggcaaacttcatagtaataattcattcagc

SEQ ID NO: 411431 - DNA, 511 bp, Homo sapiens
acatatcatattcctgagaaggaaaatgtttataagtatgccagttcttcccacattaatctttatgtccaatgtaattccaatcaaaattcctatgggttttatttggtttgcatggaatattaattttttcaacttgctagtattcatcatcttgaagaataggcaaaaggcctctttttttccccctaaagaagattaatgaaggtgaacttttcataccacttattaaaacatataataaaattacaataattatttccatgggtagaaaaattgatagatcaatggaataaaaaactcagcgtagatattgcccttagtgtaagaaataacttggaatgtaataaaggtgacactgtaagtcaatgggaaagggaggacttgttagatgaatggtgccaagtcacttggctaatgatttaggggaagaaaattagattaaatcctatccttgcactctatacaaagaaaactccggatgggttaggctgaagtaagatgtttgaaa

SEQ ID NO: 411432 - DNA, 513 bp, Homo sapiens
cgttcactacaacgaacaatattgacaggagcatcctggatgtgtagctttcggcccatgtacaggtggttcttgaggaaaacaccaaaaggctggatggctccccagagagggcacctgtcacactcccctttgtgtgagaggagtactgtagcccagaagggtcaccagggactctggggcagagaagagagaagaatgttgctctgctgatctcccagccgtctctggatcaatggcctttctttcaggcctcatgttctctgctgtaaggcacttcacttgccttactcactatgcctggcacttaataagtgttcaagaaaatggaagcatgaaccttttgagggaacaataaccaatattttcatgtatctttatgtagtcttttctatgcacttttaaattaacataattagtataatgctacacatagattatttttatcctatttatttgcttagtattacattgtagcattttccaggtcattaaaatgttcttaaattttta

SEQ ID NO: 411433 - DNA, 459 bp, Homo sapiens
ggatgggaattattttgtgttttttttctaccttgctctagtaacttagattgtgccctaaagattatgtgaataaaatgtgccagacctggttaatgcaagataaaaatcaacctgaactccttctttattagcaagaatgtccagaaatgatataataataaaaatattcttctcaggaatccaaatactgatcacagagaagctgctgaatagctttctcccattgtcatgggacagataaagacctgccaatacagaaaaagtttggggtcagccaggaatggcaaatatttggtctacattttatcatcaaccttcttcccccatggcagtgatgacttactaagtgcttataaaactctttcctaccaagatcagacatgatttcagaatacttctcactttccaaaaagccccaatcagtccattagagttggagtaagtggtttaattttt

SEQ ID NO: 411434 - DNA, 598 bp, Homo sapiens
gcagtctctcctgaacatcttgggaggtcactaagttatttctactccaattggtcataatttgtatgtttcctagctctgggaattgttcagttacatctcttcaattgttctttgctcagtctcctggaacttagctctacttatggctaccttaatattcagaaaaaactcaagatcctatgcaaatttctgaaggtttttgcataccttcttcctttttggaattttgcacagcaacttccacagctgcctcaggttccatgaactccaatctgtgcgtcctcagtgagattgccacattctgattttatgatccagattgcacccctaggcaaaaagctaggaaaatcacagaatttacctcatttgttttctttatctcaatgacgtcagttctgcactgccaattgtccaacatctgaaaacggttgttctgtatgttttgtctagcttcctaggtgtgtatggcagaagggttaatctggtcccttttaactccatcatgatcagaaacaaaagtcctctgtttcactgaaatttgattagcatgtcagtctttgagcaactgatcaaccttacaaaatggagtttgaaa

SEQ ID NO: 411435 - DNA, 439 bp, Homo sapiens
cagcatttggtgttgtcattgttttggattttagccatttcataggtgtgtagaggtagctcattgttttaatctaataaacatcttattgaagaataacacacaagcagaaaatttcagagatacaaacgaacagctttttcaaccatcacccactggatacagttctgtatccagcacccaggccaagaaactgacactaacggtgccctgtgcccccctcaggacctagatccacttccaataattcaggcttgtcttaggaaatttgcctcagaaaaatagagagagagagaagtcaaaagacagacaatctcacagaacaaacgaatgaagaaatgaatgaagaataacaatgtagaaatttaagctctttatgtgtgcacttattactacaaattctagtaattctggaagcagatgttatttacacagaaat

SEQ ID NO: 411436 - DNA, 914 bp, Homo sapiens
accacagcatccttgatcagagaagggggaggttcacatgtttgcagtgaaaagcagtgtctttgatctgcaacagcaaatcctcagagaaaaagattctggggttacttgaccttctctcctgttaagtgcagtagggcttcccctcttgactttcctggttatagctttccatcacagctccccacattctctcttgatgttgaaagcagtctctcaaaagactttgttgttgtgtggttttttgtttgtgatttttttccttatgcaaatcatactcctgcccaagaaaatacagtagttccccttatctgagcagtatatgttctaagacccctagtagattcgcaaaccacagatagtaccaaactccattcatatatatgatgttttttcttcccttaaccccactcatatgtatctgtgataacgtttaatttataaattaggcacagtaagagattaatgacaataataaaatagaaaaattataacaatatgctgtaataaacttaatgtggtctttctcaaaatatctttgtgtactgtacagacctattttcagacctttgtgggtaactaaaacagtggaaagcaaaacctcagataagaaaggactactgtagattgtatttaactgttttctgaccagtccatcagtaagtactctgtcattgtggccttgtatgctaaggcaaagaatgctgatcatgcagtaatacaacttctcagaaaagctggaagaaacctgaaaaattagtgggggtgtggttgagagaacataatgttgagatccattgcagatatgtaattactacacaacaagttagggcagttttagcttgactctgctatcattacagtttcatctcaacttctgtaaccactccctcctgtccctggggcatgcattt

SEQ ID NO: 411437 - DNA, 118 bp, Homo sapiens
ccttcaaagggcattagtgttaggcctgttacgttagctcttctgcagtctgtgactctaaattttaggaattccaattgaatgctgaaataaacccaaagggaatttttgtccttaa

SEQ ID NO: 411438 - DNA, 333 bp, Homo sapiens
gaggactgcttgaggccaggagtttgaggccaccctgagcaacatagtgagaccccatctctacaaaaatgtttttaattagccaggtgtggtggcgcctgtggtcccagctactcagagccgaggcagggtgattacttcagcccaggatttgagggtgcagtgagctatgattacgccactgcactccagcctgggcaatggaatgaaacccagtctcttaaaaaaaaaaatctgattatgttagaacaacatgtcagtttggtgctgtcacatctcttacatcttctctttcttcctcttgttaacacttaaaaacaaaaacaaacaaac

SEQ ID NO: 411439 - DNA, 567 bp, Homo sapiens
actcctcatttatgttttacttctgctacttccattgtagtgttttctttgacttgtttaatgactcattgatttcgttgtcttactttaaaattctccatctcaaattttggtagtgagtcattttactcaaaatgcctgtgcttccttgttcttaagaaatagtattgatacataacaacgaagcatattatttttcactttcattatatctgactaagaaccactagactggaatgacattacccttgaaaacagaatgaaaacagtcctcttaattaccctagtttgcgtatgtttagaggctatggtaaggcatgcttataatctccaaagggatttaagatgcattcaaaggtaaatggtaatgcatggtcatgttactataccttaaaaacccaacagtgcctcagtcctggtagctactcaagaaatgcttttttttttttgtactaaattgaattgaataaaaacattaatggttccaacatgtctgctgttgtaaatttggaaacatttttataggcaaatacacttacatttaaataaagtgacactgatcctata

SEQ ID NO: 411440 - DNA, 504 bp, Homo sapiens
acgcccttagaccttcttcggtgacgaccgccttccctgtggccctagatgagcacaagggcagtctgtgtgtgggatcccttcccattcacgctccaccctgctcttgaccatggtgaacttgtatggattacatcaatatgctacgtgccctgtggattctggctggatatgggcaatggcgagttccagcaggaaactggagggacagaagagagcgaggtcagagaatttaatctcctgcctccctccctatgaggtcaccccagctggtgactgtgaccctggatggaaggtgattgtctcaaggtggtctgctcttcgcaactctccttctttctggtaacctcgcccagcatccctctaggtcgagggaggggtggtgttggcctcattgcttttaacctggattcctgtaccatccctcatggttctctcctacaaacctttgcaaagaatccctccccacacgagcagaattttagtgcatgctctctgtgttct

SEQ ID NO: 411441 - DNA, 586 bp, Homo sapiens
acaaatgtgatgctaaccactcagagttagcatcaaattgcacaaattaagggctcagtcttccacaagattggctctacttcagatgccagctgcaaatggggctgtgggacaccagcacttctgaccagccagttacaagttcagtggttcccacaaccctctctaggtttgataacttgctagaatgactcacaaaacttcaaaagtgctatccttacaattacaattttattataaagaatacaatccaggcagagccaaatgaaaaggcccataaggaaaggtctgggagggtcttggatgcagagcttccttgctatttccagtggagttagcgagtaccaccatcctgccttgtcaatgttttcaccatccaggaagctctactgagctttcctgtccagagtatttatcaaggtttcattacataggcatggttgattaaaccattggacacgcgattgaactcagtctccagcctcacttccttcccagatatcccctggctggcttaaagttccaactttctaatcatgtggttggtttctggtgaccaggccctatgatgaaactatctagggga

SEQ ID NO: 411442 - DNA, 558 bp, Homo sapiens
cttttgcagcaacatggatggaactagaagtcattatgttacgtgaaataagccaagcacagaaagacaaataacacatgttttcactcatgtgggacataaaaaagtgaatctcatgaaaatagagagtaggctggtggtcatcagagaccgggaagggtagggtggaagaggggtttgaaaagaagttgattgatgggtacaaatatatggtttgatagaagaactgagaactaatgttatattagtatggtgactatagtttacagtaatgtgttgtatatctcaaaatagctagaagagaattcaaatggttttagcataaagcaaagacaaatatttaaggtgatgaatatcccaagtacactgatttgatctttacaaattatatgaatgtattatatgatcatatctacttctaaacactatgaacatctatcacacattagtaaaaaaggggaaaaacccctgctgacatcctgattttagcacagtgagacctgtgtcagatttttgacctccagaattgtaagataataaatttattgtgttttaaac

SEQ ID NO: 411443 - DNA, 412 bp, Homo sapiens
tgggactcctgggtcctggggctgggacagggttttctgccagcagagagtaggggagccagagatttgtcttacagccacattgcccagcaagcctgacactttctcccactgcacctgtgggagcagcctggtagccactggaggactgaagacatcccagcctcccctgggtgctgctatgtgaccctctggaaatagaagctcagtgtcccctccaaatgccagtcaccctgggccccactcacacccacacgtagcacatcttgagcgcctcctgccaggctgagctcatcccaggatgaagtgattacagccctactcccagaaggttcacagtccacctgggccatgggagggagcgtagacctataaaccagaaatgaaccaataaaacagtacagcaaagtgc

SEQ ID NO: 411444 - DNA, 219 bp, Homo sapiens
gtttgctagggctagagtagcaaagaaggcagacattgtacctaatgatcattatacattggttacatatatcattaagaaagaaaaggctgggggactgggtatggtggcgcattcctgtagtcctagcacattgggaggctaaagcaggcagatctcttgagcccaggagtttgagaccatcctgggcaacatggtgaaacctcatctctactaaaa

SEQ ID NO: 411445 - DNA, 601 bp, Homo sapiens
taacagtcagatttcaatacgctgagactgtgacgtgggacttttgagtgagtaacatctgctcctagaactgagttgagtggggatcctcccacaccacccaggcaagagaactaacaattgatgactgctccaaatcagtcgccagtctacctaatacttctacctggtaggtagcctgatacccactaacatcaggtaggttctatatgattaatagttcataagataaatattaatcattagcaattttcaaagctgaggtacagctacttcaaaaatgaagaaggaatgcagatgaagagtctccagactcttcaagagactctctgcaagcaaagtctccagagttctgagggaaagaagcaaacaaagaatcacagccattctttgagggagcaacctactcattaaagaaatgcaatcatgattatgctgatcaaatgaaaatctcaaaaatagagaggccatgggaaaagggctagttatgagcactgaattcatttacatataaaacaaggcaaaataattgtcataatactttgtaatggttataaacaccaaataaatgttatatagaggtgaatcgcataaaaatagt

SEQ ID NO: 411446 - DNA, 859 bp, Homo sapiens
taacagtcagatttcaatacgctgagactgtgacgtgggacttttgagtgagtaacatctgctcctagaactgagttgagtggggatcctcccacaccacccaggcaagagaactaacaattgatgactgctccaaatcagtcgccagtctacctaatacttctacctgatgtgatgccagaagtagagcagccatcttgcaaccacaaagcaacagcatgagtatgaaagttagtgcattaaggatgctggaatagaatgattgaaagccagatgcctaatgacgttgctgaatagctgaaacaataccagcaactagctgacaaggtcttgctctgttgcctggcctgaagtgcagtggcatgatcatggctcactgcagcctcaacctcccaggcacaagtgatcctcccacctcaacttccagaatatagaagctggaactacagtgacctacatccaaagtgaaaagttattcagcctctgaagagaagcattttgtttggggatcttcaagtatgcttgtcagtttgtcttcctgactgctgacactgctgaccaagcccaccaccagatgcctggctgcacacccagagggcagccgcttcccgtggtcctctcgaagaacttcccttttgcaatgcatgtttagcaagtggatgagtttgtcttttctgatttctctgcaagctctgcattgcccacctgaaccagtgcttcagaagaactaatgggatctctgaccctccaacatcctcttccagactttcactttcctggctccttgcagggacatgtaataaacccggatgcggccgaattattaaatttcaaatttagattagtatccgaaccccgt

SEQ ID NO: 411447 - DNA, 323 bp, Homo sapiens
cctcaaatacatatttttatcttttctagcctaacatgttatttctcttattatacttatcatcagaaaatctggaagattcagtaaccatcagaactctgaaatacaagtcatacttaatgggagaaataggccaacagtagttttcctctgttgtgtttacctttcttttttttgtagaactattttattgaggtatgattgacatacaataagctgtatgtgtttaatgtataaaccttgatgaagatagagatgaatacatactcatgaaaccatcaccacaacctatgccataaacatattcgtcacttccaaaagtt

SEQ ID NO: 411448 - DNA, 847 bp, Homo sapiens
aaatcattgagattttcattaatgttttctttgggtcatgcaagtaagtgctgtccaaagagcttggatgcagactgtcctaattaccctaaatgatccctcggacaccagcaaatcgcggccacctccctgccgctgtgcttcccctctgtccctgttactatggccaccagagggctggagagtcatttctctattcctccagtgatcttacttcatcctcacctcccactatttgtgtgatgcaaaggaacttccgtgttttttgagataggtgagaggggtatgtacaataactcgggaagggctggacgctgctgataaattctgttggtctcactttggccaggctgttaacgggtgctgtggattacagatgatcgcactctgggcacagtcctctggaaatgcagatgcccgtgtggaggaaattctggcgggagaggagcggcgactcgccgctctgcttggatctcaaggcatgaggttctgggtgtgcctcgcagcctgcagagccatgtggggccttgctgccagacgaggacgggctgaagacagcagctcgtctccagtggacgcctccaagttcccatggaggggtgggcagcatcgcaccaccatgatgccttgtctgctgcgggtgggagttttcaggccctgtcatgtgagacccacgggggatccttcctgcgatgtgcagcctccacgactcggcttctccagagtgccagatacacaggtggcattttatggcagtggtcactgggacccaactcccttctctgtacacagctgtttttttaatttccaggtcagaaaaattatcttcctactttgaactcttaaa

SEQ ID NO: 411449 - DNA, 475 bp, Homo sapiens
gtgttcagagagggttccattctgggagaggcccccactttccccagaggtttcagattcgagtcaaccttgctgctggcaaatgtcagcagagaatttcagagcttgaagaatccttagagagcatcagttcgagtctcttacccggaaaaaactggggggcccggagaggctaagggtctggagctcaagatgcccgccaggcagtggcagggcagggtggtgcctggactgtgcaggacggctctgtctcttcagcctctctgtcatccccgtcaggcccactgtatttggagatttcgacgttgccttgggaacccctgcccctccccacagtgcccgcccagccccctcccatttcccctcctagcacttacttgcccctggccctcctcccagcctgtttccccccatgcgggcaggaactgtattgcactcactctaataaatagatgattggaccaattaaggaagc

SEQ ID NO: 411450 - DNA, 475 bp, Homo sapiens
tacatccgaacggtggatctctgagtacttaggatgctgtcaggcattgtcattgggatctgtaacaccaccctcctaaaatccagctcacactatttaatataagttgttgcatgtagaaaaggcctgcgaacctatgatcataggttcgccgggagcagcagcatcaacaacagcaacagctgaaatagcttgtgcaggacattagagctcttcatgggtagagtgcaggaaggccatgacaatggaagcagtaatagaaatcatacagggaggaaaatgatgtgcagcttaatatggtgagatgcccagtagaaaaaggggaaaaatgtttattctgtttataagggaataacatgtttctcagccgtagcagccccaggggctaagaatcaagaaatagggatcaaaacaataccaggaatttgaaattccttgaaaatcttggtttagagtcccttctgtataactgtgc

SEQ ID NO: 411451 - DNA, 541 bp, Homo sapiens
gcactcagagactggactgtgttagctgggaaggatcacagtctgccaggaaatcagttctcaccttccaatgggacaggatttgagggtgggagttggggtaggagaaagggagcagagaggaaaaatttgtaactgtcatgcaaaaggccagttaagagaatctcaactactctgggcaccaaagagcagcttttagtagatagttgagttggagccgggagcagcagcatcaacaacagcaacagctgaaatagcttgtgcaggacattagagctcttcatgggtagagtgcaggaaggccatgacaatggaagcagtaatagaaatcatacagggaggaaaatgatgtgcagcttaatatggtgagatgcccagtagaaaaaggggaaaaatgtttattctgtttataagggaataacatgtttctcagccgtagcagccccaggggctaagaatcaagaaatagggatcaaaacaataccaggaatttgaaattccttgaaaatcttggtttagagtcccttctgtataactgtgc

SEQ ID NO: 411452 - DNA, 227 bp, Homo sapiens
ggaacaggaaggcaaagcagagggggggtgcatgtatgcacgcacatgcaagatcagaagggactttttacgaattctttccttgacactcctttttttgtgtcgcaactttgcctgtgaacccttagaatctctgctaatgagccggtcgcagtggctcatgcctgtaatcccagcactttgggaggcagaggcgggtggatcacctgaggccaggaaccgagatc

SEQ ID NO: 411453 - DNA, 271 bp, Homo sapiens
aaatgtctctacctctgttttcctaccttttctctttctatagctatgtatgtatctgtagccctctagatcccatatgtgtattccatttttaaccacatgccatatctattattatcccctttccagcctcacacttataattcacctaactcatcatggagttccgttcctcatatcagaaaaggtgacacatatgcataattcaaagataggaaaatggataaaaagccatgaaggttgcaaactaagggccaaaacagtaagaaaa

SEQ ID NO: 411454 - DNA, 101 bp, Homo sapiens
gactataagcctttgtcaaactcattgcagtgtactctaacaagatttattttactgcatgaagttaagacctcaataaacctgaatttttaatgccatga

SEQ ID NO: 411455 - DNA, 242 bp, Homo sapiens
catttttcaacagacttcaaatattcctcaaataccacgccatcttccataggttgcttttttggtttttcagagacctgaggccacttggctttcttttgatggccgaaacactagagcagagtcagggagtttgtggctgtccagaagccacatgccttgtctctgaaagttttatttagattatgttgtattatctcccatgggtaggtttccactaatgtgtggcttatgtgaattat

SEQ ID NO: 411456 - DNA, 298 bp, Homo sapiens
ctaaatatgtcatctagcacctgaaaaaatttaagtctggttctttctggataaaagaaagcgcacaggatttaagtgagtaaatacttaagtgagtaaattcttagaaaaaacaaaacctaaccgccacaattggactttggaacttttttccccccttagcagcaggctgaaattttcagttcctcggtcactgatcagggaattctgcgcttcaggctgtgtacacccgcaagtctggaagggtgatgatgatgatgtgatgatgagttagggcaattataactacggcaaaaaa

SEQ ID NO: 411457 - DNA, 327 bp, Homo sapiens
gtgagccacgatcatgccattgcactccagcctgcgcaacagagcgagagaccctggctctaactaactaaccaagtaactggaaacatagaaacatgttaaacaggagacattcttccctttccttcaaagaacagccatcactgggcccctctccccttgaaaactcagaactggcagaagcagctaacaagcaacccagagtccaggtaagaaaagacagaaagagaagctgtccagacatcaggcagctgcccctctgagcctgcctggaaccacggcccacatgccagcccattaataaaataataatgaaaactactcaca

SEQ ID NO: 411458 - DNA, 333 bp, Homo sapiens
tgggaacggcaaaggggccccaggatcaggggtcagcaaggtacccctcacttccaaatgtcttcagggtgctctgcaaaataaaacctgctttgacgcccggagacaatgaagctgccaaaacccagctttgtgctgagcccttgggaggagaacaaagtgccatgtcacatggccactttgttgttgggactggattttagaacgggactggaaagggacacgttctggattttagaacgggactggctgcggcctgaaggaggaaattttctctgttaacctcattggaagctgtaatcttcaaaagacctttttaatggccctttaaaa

SEQ ID NO: 411459 - DNA, 999 bp, Homo sapiens
ctcactccccacaccaagttccacaattcttcgtcctaaagacttctggaatttgatcacttctctttttcactcaccctaattctagtccaagacatcattacttctacgatgaactaggcaattgcctcctttccacctgctcttcacaaagcatccaagacgatactgaaaaatggacaatctcattatgtcactatacagctttaaaaccttgcttttaaaataaagaccttcttatagcctaaatatgcttgcatgatctggctgatcctgggagacttctacagtcttatgtcctgttcttttcctcttgtacccaatgctccgacccacagagatcatctatcctccagccatatggaactccagacaatttcctgttctctctgctctgtgccttgccccctagcctttggccatgcagtctactgaggctggaaagctctctgtagcctctgcctgtgaaactcttattctgcagtcaagattcagctcaaactgcgtcctctgtgaaaaccctctgccccccacaggctatgcttagcactcattacactggctagcaaaggcagccgccaccaccagacatgagcactccactccacgtagccaggagatctctagccttcctctcatccaccaaccgtttcagctcacccctggttgaggtcgttctccgtgttgtccagccacaggcgaacggcgactgcgttgccctcccggcactgagtgaaaatgtcgtccatagcagcgtcccggcgccgagtcccctggattggggaagcctgaggactgtggagtgatccagggaaggaggatgaaccccaagctttatcctctacaggagagaagtgtttgtgttgggggtagggggcctgagctgcgtccccggctagtgggggtctgtgaaggagttcggggctgcgggatgacccctggctgtgtcctctagacgcgagccgcgcctggttaaactcgatggttcgctgcgccgcg

SEQ ID NO: 411460 - DNA, 430 bp, Homo sapiens
cctgtacacgctgggcacaaagcaggaccctgtctttattttttagcgacaaagcaagaccctgcctctattttttaaggaaaattatttttaaaatggttaaaatggtaaattttgtgttatgtgtattttaccaaaattttaaatcaatcaatcaataagaccccaaatgatgccctaccagagctgagacttcttccacgcagtcctctcatcctcctggccactcccgcccccagcagcagggctggtcacctggtgggtgcacatggacatccaacaacaggaggctgtgtccacctgggccacaccctaatgtcacacagtgaaggacagaggaccccgtatcctggcctctggcatatcaggcagacagtagcactgcttcatttgggctgacatacctttgaatgtttagataattgctagc

SEQ ID NO: 411461 - DNA, 492 bp, Homo sapiens
acttaaattgctagtgaggaaaattaattttctcttgttcttatataaaacaataaagtcaatttttttagtaaaatatgccagaatatcccagtacaatcaaatagcttataataatgacatttcagtaggcacaaggaaaaaaaattgcagattatcttattttcattctagaattgttaaggacataaaatctgagaagcttgttagattattgagaggggaactgatagaaatgataatcttatatatttatagaaaatacttaaatttcacttggtattcctctgacttccagataaacactatgggaaagaaggccctgtgattctttttaagaataatactgtgcttctaaggctactttatatcaattatgttttctgatgaatcacaaaatgtgattgtacaaaaacaagcaaaaaggttttcaggtatttgagatttaagaagccatcattttgccacatgaagtacctggttcttaaaaaa

SEQ ID NO: 411462 - DNA, 373 bp, Homo sapiens
cttcaacatcagtgaaattcacttttataattgcatccattaacattaagcattttttcttttaacctgataccagtgttgctgtcagcaagggaatgggatagccaacactgaaggactgactgtgatccttcagtgacaggtgctgggagcactctctagagattgccttgactgaagacagtggctttgttaaaggtcttgactcctagggacaaccccatccaattactgatcaatgtgggtatataaaggccaggacctcttgctttagctgggaacagctttgaggaggtccttcagaggtcccagtgggttgactgaaagctttgtagggaatacatcgcaaataaatttctttctctgcccagtc

SEQ ID NO: 411463 - DNA, 386 bp, Homo sapiens
ccatttattccttagcccactgattttatgtcagacactccaatgggactaaaaaggaacaaatgccctcaaggcagctcaaggcactgatatccagtagggcacacagaaaagtgggcacacaattcaatcagcagaggcagaactttgtcatcgcctctgtgatcccactgccatctccccagtggactgtgagcctccagaagagagagcatcttcatgtcttcatctttatagtccacaggaacttggacatggtaagtgtggtctacagggtgtacaacttgtatttgtcacaattgttgcattaaggaatgaatgaattcccagcctctttaagtttggctctagcacagaaataaaaagaaatgaaacattaaaatata

SEQ ID NO: 411464 - DNA, 348 bp, Homo sapiens
gttgtgggacttcaccttgtgattgtgtgagtcaattcttcgtaataaactccctttcatatagacacctatcctattagtcctgtccctctagagaaccctgactaatacatgcagaaatcgtgtggtttgtagtatttcttaatttttattttctggtcaaagaacagttgttctatagaatggtattcatatatgctgaccacaaatactccatgggacagtttgaggaacagtttttcatggaatgaggcctcattttaacaagagtacaatgtaagggtcacatttggccacaagtgccatagcagccacccatgaggtttcaataaaatgtgaattctctcc

SEQ ID NO: 411465 - DNA, 758 bp, Homo sapiens
ctttctctgagcttgttaccgtggagggctgggcccggtttctaatcgcccccttcaccgggctgcctgccgctggctgcggaaagtgtgggtttggctgcatgatggcctcgtaatggctgtggtgacgccctctgcgtcttctcccagcgccagcctttcaacagagcagcacattatgcctggataagactcaaagagcagcttaatatcaggttctctggggctgtaatcatcggttcaggatggagcagacacagccgcagcaaggcctctgtgcagcccccggcttaaaacacatcaacgcatccgtgggcacttttgtgagttaaagctcaacttacacatctgcctgtatccataggaaatgaatgaaaataaacaaacaaattccttgcattcaacgcagcgtaagaaaaatcacatcctgttccccagtagctgaggaaagccggctcacgagagtatacagggagaagaggccagcattgtgtggctgccagcaaagctcacttgtatgtcaaatgcagcgcttttcttagcccattatgtattttttttttcttgaacactcctgtgtctaccgggatctcctgtttttattgttttgggatgagattttaaaaacaccatttaatgtagcctgtgtgctcttgttcattaaaccaaaaagaaaccctggatcacggcaaataaaggcgatgcggccaaccttttttttcttcggatatcacgacaacaaatacatcgagtcgtgc

SEQ ID NO: 411466 - DNA, 497 bp, Homo sapiens
cctttcaggtggacatggactccatggaagcctgagctgccaggggcttccctggggcagcactgcttcgcgtaggctcacgagaaacttccagggttcctgggaaatgaatgaaaataaacaaacaaattccttgcattcaacgcagcgtaagaaaaatcacatcctgttccccagtagctgaggaaagccggctcacgagagtatacagggagaagaggccagcattgtgtggctgccagcaaagctcacttgtatgtcaaatgcagcgcttttcttagcccattatgtattttttttttcttgaacactcctgtgtctaccgggatctcctgtttttattgttttgggatgagattttaaaaacaccatttaatgtagcctgtgtgctcttgttcattaaaccaaaaagaaaccctggatcacggcaaataaaggcgatgcggccaaccttttttttcttcggatatcacgacaacaaatacatcgagtcgtgc

SEQ ID NO: 411467 - DNA, 552 bp, Homo sapiens
tgaattttctttaataactccaaattcttcagggaaaacttccacccacacagcagtgatgactgctggtgctctgagggaattacggcacatagtaataaaagatgtatagaatttctacatcagcaacgtgaagtccagcccagcaccctagtatggagaacagatggagttccagaaggtagaagcccataccggaactgggggcagtggaggggatgccatgtggaaaattggttgccaaactgaggcctcagaaatgaatgtgaaataaaccttctccttcacaaatattgtagagagagtagagcctatgaagttggaggaggttgccacacggattatactcagtagacacaaagcatctcaacttactacaggaaaaccacctttaatgaaagcaaccacagttcccacattcatctctccccttcttttcttgggtgctttcattaattgcaagtaaactttcaaagtcagagaactatcagccgtatagccacctaacgaaataagacaacaaataaatgtgaattcattttaaaaaaaaaa

SEQ ID NO: 411468 - DNA, 343 bp, Homo sapiens
cctaatccccacctgagctttgcactgaccacccaaaacatacatgtaagttgattcatttgggaaaactaaaggctgggcacggtggctcatgcctgtaaccccagcactttggaaggctgagatgggaggatctctcgagaccagactgggcaacatggtgagaaccatctctacaaaaaagtttaagaaattagccgggtgcagtggcaggcacctatggtctcagctattcaggaggcggaggaagaattgcttgagcccaggaggtggaggctgcagtgagccatgtttgcaccacagcactccagcctgggtgacagagcaagaccttgtctcaaag

SEQ ID NO: 411469 - DNA, 369 bp, Homo sapiens
aattcctgtctgtatccctttcacctagcacagtccatgacttaggaaaaaaatgttcagttgtgttggttggtttatggaatggattaagtggtaaagagtacagttttgaaatcataaaaaatgaattggaatcttggctccataaacttaccctgatgtgatgttggccagattatgtaacctcttgctccccgagtttgctcatctgtaaaataacttcatgaggttgttggaagaagtaaatgagttaatacacaagtttttgaatagcacttagtaaatgttagcagctgttgttactgtcatataggattgcttgcatttttaatctttttcaaaaaagaagagttatttgaacacctagcc

SEQ ID NO: 411470 - DNA, 370 bp, Homo sapiens
tatagtctaagcagattgctacataacattgcttcaataaaatctgcgaatcaagaaatttgttggcagtgtgagagttgacagattatagctttcagttcatgtgctctacactgagaggtcatcttccttttcctttgcaagctcttcaggtgtgacataacactaaagtctgggcttcagctgatcccctaacacactgcacagtcaggtaaccattgaccacactgcattataaattcatagaccaagatgaccagagatctataaaatatttaaaaagtaattgttttataaaaggtctatctaaacaaatattttaatagactatcattaaaaaacaaaataaatatattaatatcatctgtat

SEQ ID NO: 411471 - DNA, 284 bp, Homo sapiens
taaatcagataataagcaagaaattaagttcactttttaaaagttgaccccatcactggccttgtaagcagaagtgttctgaagtaaattgggggtaggaggggaaaaccatgtgaagattgtctagatgacagcatgatggaaggaagcatccccaaataagttatgcagatacgctgagctggcaacagtggccaatttgcaggaaagtagatgatgctctttcttcacttgggtgtgtttcactcaagtatgtagaataaaaataaacacatttttaaagg

SEQ ID NO: 411472 - DNA, 382 bp, Homo sapiens
aataaagagatggcacagcgatccctctgcccttaacagacacctctgggaaggaacctccagcagggcaatcctggtcatcatcaaaactccagtacgaatgcagtcactgccatttgctgtcctgactactcccaagaggtggatcatgttctgcctcagatttatgttcctgaaatccatgtatattgagttgagatgagcaaactggagttcaaagaagtgaaacagcttgccaatgtttactcaacccatttgtggtgagtccagtctccaaacacaggaccgattccaaagcctcaactctagttccacactgtactgctctcctggcacagagttcggacttgttgaataaatccctgatatgcaccaagtcaaa

SEQ ID NO: 411473 - DNA, 265 bp, Homo sapiens
ctctggggtcagtcctcaactgccccaactgatagcaaatggtggataaataccccagctccctcaccctcaggtgggataactctgaggcatgttctacgctgtcccctcattccctagcagtattgagctccaactacccacaggataatgctttcttgcctcacttcccattccactaccagtgtctcctgggatcacctcctaaataaactactggcactaaaatgcttgtcttgggggtctcttctgggccaacccacac

SEQ ID NO: 411474 - DNA, 422 bp, Homo sapiens
acaaacaaaacaactgaatagaacttctggagtaaaagtatacaataattgaaatttaaaagtaactcaagggccttaacagaagatttgaacaggcaaaagaaagaatcagcaaacttgaagatagaggattggaaattatgcaatccaaagaacagagaggaaaaagggaataaagaaaatgtatagagtctcagagaaatggggaacaccattaaacatagcaatatatgcataatagaattactaggagaggagagagagagaaaagggcagaaaaaatgctcaaagaaataatgactgaaaacttcccaaatttggtggaaaacattaatctacacctttcagaagctcaacaaactccaaatagaatgatcacaaagagatccacaccctgatatatcatggtaaaactgcttaaa

SEQ ID NO: 411475 - DNA, 476 bp, Homo sapiens
atctctccactgatgattatagggttagaaacaaaagtgatggttctgtgcagataaggttatatgtagcctttgacctcattgctgattattaatttttcttaactatttgtataatatacctttcaccttggctctttttaaagccttcaatatgaataatatgtaacaatgattcttaatatgcgtgtaaaaggcacataagaaagaaaatgtcatacctttgtcctgtagtttggaaaactaagcattttataagcaaatatgttcttttattctggtttcctgttatgacttctataagaaatttatgagtaatatagtctgtcacaatgttcatataactgaagagaaattaaatataaagaatattgttcaacttttgtgaattgcaagtagatagcactccaactccaaatcatctttatatgtgatataaactgataaaccatgaaataattttcattaaaagatct

SEQ ID NO: 411476 - DNA, 713 bp, Homo sapiens
ctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgaaa

SEQ ID NO: 411477 - DNA, 361 bp, Homo sapiens
aatctcgataatttcagtaaataaggatgtaatataataacaatactaaataattgattccctaattataaactccagagtagagactgtgtcttgaatttttttgtgtcttctgaggttctgagttccatccaaagtgctggcattacaggcgcgagccaccgcgcccggggggaaaatgttttttttaaaaaaagaaaatattgaatgtatatcttgtactaggcactgtgctaggtattgggaatatagtggtgactgtagtcacctcatagaatgtagagtgtgatggaataatatatttaacaaatgactgtttaagtgaatgcatgcatgtctaatgctactctgtagtcgtaaa

SEQ ID NO: 411478 - DNA, 478 bp, Homo sapiens
aatctcgataatttcagtaaataaggatgtaatataataacaatactaaataattgattccctaattataaactccagagtagagactgtgtcttgaatttttttgtgtcttctgaggttctgagttccatccaaagtaattaagtaccaatttgggttattcatttagaaaatatttaagggggccaggcattgtggctcatgcctgtaatcccagcactttgggaggctgaggtgggcagctcacgtgaggtcaggagttctagaccagcctggccaacatggcaaaatcccatctctactaaaagtataaaaattagccgggcatggtggtacatgcctttaatcccagctatttgggagactgaggcacgagaaccacttgaacccaggaggcagaggttgaagtgagtcaagattttgccactgcactctagcttgggtgatggaatgagactctgtctcaaaaaaaaaaaaa

SEQ ID NO: 411479 - DNA, 369 bp, Homo sapiens
ctgtgttgcccaggctggtcttgcactcctgggctcaagagatcctcccaccttggtctcccaaagtgctgggatgccaggtgtgcaccgccatcctcggccttactcttctcttcctctctcagcccctctgcctcactatccctctttctgtgccctcccccacacagccccccacacttcttcttagtctcatcttcagcttcccatacgaggccatcctcatgaaatcaggcactgggaggtccctggggactgacaagtgccagctgtcccttgctgtctctctgccccatggctgcagcagggagggtgggcaaagggcagaggtgacagtggccaaacctgaaactgaggcccagctctggt

SEQ ID NO: 411480 - DNA, 1048 bp, Homo sapiens
  misc_feature (1048)..(1048): n is a, c, g, or t
gcctatgacctggtgcacaactttagacaccatcatcctggagcagcactgcaccctcactagccagagtgttgacatcctcaaggccagggccacattcaagactttggacttcattgatgcacttgtgctgagcaagatcctggtcagagtaaaacattccatgggaactcgggctgtgagaaacatcctaaccacctgactgcagaaacatccttatcacatcctgctgggcaaaggcccaacagcctgacttcaggaacatccttatcatcttctactgagcagcaagctatactgtccagagccctccctcccagccccatgattaccccagcctgtaagtggcagtgggcgctgacactaagctggtttccccctccgcagggttttgctagtaataaacctgtgttgctgttgaaaaaaaaataaaaaaagaaaaaaaaaaaaaaaacaaaaaaaaagagagagggcggcgcgcgcgcctccaaaaaatttttccccgcggggggcgcccaattttcacgctcgtcccccagttttttttgttcacaaagggggccccctattgaggggagccggcttttataaagacaccagaggagcagcgggggcccgcccgttttaaacaacaccgttggaggagacgcggggaaaacaactcggttctgacctggaggagacatctctgtggggggaaggagagacacctcttaatcttcgcggggggggggggagaaccacatattgtggcggccacacaatcctcatcctctaaagcggagaagattttttgagagagctctcttcgaggggggataatatgatagagacactgtttttcagagacgtgtttgatcaggtgcgtggttgaaacaacactgaggacgcgaggcgatatatattggccgtggagacgtggttgttgagaaaaaatttttgtgcgctctataccagagggggattattagtggaatcattgttggcagacagaatttttttttttccgccgacggggggatccctttggttgtatatataaatgatn

SEQ ID NO: 411481 - DNA, 255 bp, Homo sapiens
tgcagattcgaggctacctacttctcatttcacgttggaggtttcacggatcctacatattgcagagaaacctgaggtccgtttttggttttgctttatagtgataaatccgggatgacacagccgtgggccgtgttgagggctgggatttcggtgcagttgaatccccggctgtggccccagtgcccgttcatgggcccctcccgtgtgattctcccagctgagccgtgagttcgtctgagcggcgagtcggaa

SEQ ID NO: 411482 - DNA, 535 bp, Homo sapiens
aaaaacacaacaaaaaccttattacaatcctgtgaactagctactgtcattactataatgtagatgaacaaactgggacatggacagttgacaaaacattcccaaccacacactaggaatgagctgggataggaaaccaggcactctggctctattactcctaatgccatacacacgagctgacttaggagaaaacagaaagtactgttcgcacaatactaactggttctaccgccactgttcgcttgcatttgttttttccttcttgttaggaacacgtatctttgaaggaggtatcatttctcccacaattctccatttaacgtttcctacagtgttaagcaccaccgaggcctctcatagccccagagaagaagtaatttgcttcctagaaatcctcactgtatccagattccctcccagaggagccatcagttctcatgggtggcactttttctccagctgattacactttttttctgtaccagttaatttttccaacttttaattgaataaaggcagttttcttaaaaaa

SEQ ID NO: 411483 - DNA, 450 bp, Homo sapiens
cagcccgtgtctcaggccctgccaggggatgaatcaattagcaagagaagcaatgatgcaaatgctccgggtcacttgggatgctgtttgcctttttgatagagaaagcacaccataaataacatcacacctcaggaaatcattccaggaggccccgatgctggcagggctgctgccggggacggaaggaatcgtttgctcattgtgtgtatttcccccagctcagtcaatgggagatttgtagtaaaatcaaagtatttaaaaggaggacagtatgtggtaacagaggcatgtttagcaatttttttagtaccagaacctgtgatttatgacccagagttacagccaactttattacaaaaatgacttcacccataataaccttattcagggccctctgatgaatgatgtagtatccaacagcattataatctagtaaatattcaaaca

SEQ ID NO: 411484 - DNA, 724 bp, Homo sapiens
caaaaggggaaagtgtgaacatgtaatatgcctttcctgtgtgggagtccttacgacatggtttgcatcagaggcttcattcattcatcccaaagacactaaagggtacatgctgccatatccattgcagagatgagaaaacaggcaaagagggtgtgaagtggcttgcccttccaccaacagctcatttcagagctaggagaaagacattgggggcagacaacctcaaagttttcttccatcctgaaaggttggttcaaggaaaatgtagtagaatgaataatgcccttcccaccacgaccaccaccaaagatatgtcctggtccccagaccctgtgaatatgttaccttatacggcgaaagagattttgcagatgtgattctgttaaggattttgagacggggagattatcttgtattatcagggtgaccccagtatactcacaaggatacttaaaagtaaaaggaagtagaagagttcatcagaggaagatgtgactgcagaaaaaaggcacagagatgcattgctgctgcctttgaagatggaggaaggggccacaagccaaggaatgcagccaacctttagaatctggaaactgatttcccctagagcctccagaaggatcaccacagccttcccaaggcttccgttttagcccagtgggacacatgtcagactttcaacgtgtcagaactgtgagataataaatttgggttatattga

SEQ ID NO: 411485 - DNA, 428 bp, Homo sapiens
ctaaattgggggttaggattgaacatgcagtttctggggctccaactccagacttctagaatcagattcacttgaagtagggcccaggaatctgcctgttaatcaacaccccaggtacatctgaagcttaagaagtttaagattgtgcttgttacatgccaagaaagattcctttggactataaagggagatcccttggactataacgtcaagaggatatacagtaaagaggacaagctctggagtcagcctgagacctatttcagatcttcattgaacctcagtgctcccatctctagactggggtactatgcccactcctcaaggataagtgggctactgtaatctgtgaagcacaggatgtggcacaaggcacccactcaatgaacactggttgaataaacttgcaaaagacggtgaccgcagca

SEQ ID NO: 411486 - DNA, 562 bp, Homo sapiens
tcatgtccatctgaaaccagtgaatgtgacggtatttggaattgggtctttgcaaatgtaatcaagttaagatggggtcgtactcgttggagggagtcctaaccccatgactggtgtccttggaagaagtgaaatctggatacaaagacacagatacagaggggaggaggccacgtgaagatggaagtggagactggagccacgtatctacagcaagcaatgccaaggatggctggcaaccatcagaagaggagacaagcagggaacagtcttgccttcagagcctaaggaaggagccaaccttgtaaaacctgttttcaaacttctagcttctagaatggtgagagaatatgcccaaattacctctcatgactcaggagttccacgctcctgtccttagtggctgaagggaccgtttgccacttccttctgaaaggacccttgttactcagacacgctcccatcaattcagatgacagctaactgacatgaacacccacagatgacttcttaacataatacaaattgcattctgtgaataaatacttattggcttggcaaa

SEQ ID NO: 411487 - DNA, 458 bp, Homo sapiens
taaaatagaaccacctgtgtttggtgggagaagggctgagggggacctctctggacactgccctccccaaccagcagccatgtagaaagatggcaagacgaagtcactcagtggccttgagggaccaaaaggatcacgataacattggtgacttctctggaccagccatagccctctccgctggtttttcctgcatgctgggggcctcaaaatgactgaaattgaaaatattattcattcatttattcagtatttactgagccataaatcaatacaacgcttaacgaaagcaatttggcatcatctgctaaaatgacaactgcaaataccctttgattcagcgattccactttcgagaatgtgtttcatggatgtatttattcttacacttaatcaaatccatataaggttatccattgctgcattttcaggaattaaaaaaaattggaaacaaaaaa

SEQ ID NO: 411488 - DNA, 783 bp, Homo sapiens
tatcagtcgtcactagaggactctggtcataaaaagagcaggccttcagcagcttcaaacagccatcttaactgacactgtcttgctgtcactcataagaactcagaatctgccactgaagcctctgccacatgaaagattcttccttgaaagtcctacgaaccacccaacccaaaccaggagattctttgcaacttcctagcactccctggagtagtttgttaaccagtcctagttcttttccagtcctagttctcctacttcttttctcttgattttaaaaaatactttgtggaatgtttaatctattcatttatatattgattaagtgtactattatgtacagtctgcaatgttgactgacttgtgaaatggcttgagcctgtgtgcccacagctctgactcacgactgaacaggaaatactaaggagactcacctctttgggaactccatgccgcttgtggcttttgtgattgaaatagcatcaataaaagtcttacactgtgggaagacacaaatgtgcgtgaacctggttgtttctgaccttgcaccacacatgaaactcaagcactgggctaagtgccaagaaacagagagcgagagaaaaaaaaaaaaatctggcgcctgaccacaggtgcttctgatctgtggctattatctactgactacagaaagctgaattagtagcttcaattccattccctgttaccagatatttccaggacaggaagttgtagaaagcttattaaatgagtaattaaaactagatttaaaaagattaa

SEQ ID NO: 411489 - DNA, 851 bp, Homo sapiens
gctttcttggccacaggccgggtgctctgtggggcctaccctacgcctctccgccgtcctcccccgaactggtggttacgcgggccgcgagttaccgtgagcacggctgggatgctgacggggaaagagctgacagagaaggcggacggcatggtgttgggaagcccgctctcacagcaaccgccgaacccggcctggccagaatccacagaggagggcgccaaatcctctctcgtgagatctgcccttctcacgaaacttgcgcttgcttcctctcgcggtcccagcaggcagctgattgtttagatggagagaccacaggggagagttacctgttgctgtgggagcaatgaggagttatggaggaaaggagaggtaccaagaccagatgaggactgaacattagacttcccatgattgcagaactgtccttcgctgcagctgtaaaatcgcggcaaggcaggattcatcctggtggtgggtgcaggccctgattcccgtcactgagcagggatacagcaggaagctccacctctgagcacagcaaggggattgttctgattctgagtgtgtctgtttgctagagcggtggccacacttccccggttctgcaattgtggataatttagcatgacttgttgggcattgcaaatgtcatgtcgtggagagtctgggctctgttattttttccagctgtgtgtgtgtgtgtgtgtgtgtgtgtgcatgcacgcgcacgcgtgtgtgtgatgagaccattaagttggtttgacagactgcaaactgcctgttgaacagcagctgaattcttaatttggttcttttatccttcttgtgtttcgtggagtttgcct

SEQ ID NO: 411490 - DNA, 750 bp, Homo sapiens
gctttcttggccacaggccgggtgctctgtggggcctaccctacgcctctccgccgtcctcccccgaactggtggttacgcgggccgcgagttaccgtgagcacggctgggatgctgacggggaaagagctgacagagaaggcggacggcatggtgttgggaagcccgctctcacagcaaccgccgaacccggcctggccagaatccacagaggagggcgccaaatcctctctcgtgagatctgcccttctcacgaaacttgcgcttgcttcctctcgcggtcccagcaggcagctgattgtttagatggagagaccacaggggagagttacctgttgctgtgggagcaatgaggagttatggaggaaaggagaggtaccaagaccagaccaaatccctgatggctggtgtggccaggcatgtagtggaggctggccctggagagaagaggaacagaaactgattttaatctcaaggggctgaagctggagctccacatgtgacccccagaagcacgggaccccatccgggacgccgctgtgcatgcagctgtcacatctccctggacccccctctgctggcagtttctcagattttccttgttttcgatgactgggatagttttgaagagtaatggtcaggcatgctgtagaatttctctcagttggggtttttctgatgatctgattgggattatggaatttggggaagaagaccatagaagtaaagtgctatttttattaaaaaaaa

SEQ ID NO: 411491 - DNA, 717 bp, Homo sapiens
cacaggccgggtgctctgtggggcctaccctacgcctctccgccgtcctcccccgaactggtggttacgcgggccgcgagttaccgtgagcacggctgggatgctgacggggaaagagctgacagagaaggcggacggcatggtgttgggaagcccgctctcacagcaaccgccgaacccggcctggccagaatccacagaggagggcgccaaatcctctctcgtgagatctgcccttctcacgaaacttgcgcttgcttcctctcgcggtaatttcatggcattgctaggtccagatatcgcgatatttcctggtggtcgctgtaatacggaaaacttactacgctgctgtgggacttgtgctcgctccgccaggaggccgagggcgtctttagttcgttaacagaggagcaggcggaggcgggtggaatttaggaggtttgtttcaaaggctcagggcgctgtaccgccacgccagccctgtcccacctgggactccctagaagggtcagagcatcaatgaggacggtgtccgccccgagaccctgcaggagccggggacattgcccactcctcggaccctgcaggacttgggaaggtgtctgctctcgcgaccttaagggcagtgcactcttagtctgggtcagcttagggttatctgtcttcactttggagatttaccagatgttcttacgcttcacttcgttgttcaacgac

SEQ ID NO: 411492 - DNA, 2064 bp, Homo sapiens
accaaggttgagaggccccaagacccagttcctttacagaatcaaccctggggtggctttaggactgggctctttggagctcatccttggacccacagtggagtgctggtccgtgctgatgtcttcagataccaatcaatgggcatttggctccttgcttccactgacctcttgagtactttcaacgatcggtgtcaggagtgccccagctgctgtttctagagcatctctgcaacccacggtggcctctcctctctctgcgggccatggacagcacagtcccttcagccctggagctgccccagcggctggcactgaacccaagggagagcccgaggagtccagaagaggaggagccccacctgctgagcagcttggctgcagtccagaccctggccagtgtcatccggccttgctatggcccccacggccggcagaagttcctggtgaccatgaaaggagaaacagtgtgcacggggtgtgccactgccatcctcagggccctggagctggagcacccagcagcatggctcctccgggaagcaggacaaacccaggcagagaatagtggggacggcacagccttcgtggttctgctgacggaagccttgctggaacaggcagagcagctgctgaaggccggcctgcctcgcccgcagctccgggaggcctacgccacggccactgcagaggtcctggccacactgccctccctggccatccaatctctggggcctttggaagatccatcctgggccctccattctgtgatgaatacccaaccctgtcccccatggaccacttgaccaagctggtggcccacgcctgctgggctatcaaggaactagacggcagcttcaagcctgagcgtgttggggtgtgcgcgctgcccggggggacactggaggattcctgcctcctcccggggttagcaatatctgggaagctctgtgggcaaatggccacagtgttaagtggtgccagggtggctctctttgcttgcccctttggtcctgcccatccaaatgcaccagcaacggcccgtctttctagtcctgctgatctagctcaatttagtaaaggaagcgatcaattactagaaaagcaagtaggccagctagcagctgcaggaattaatgtggcagtggtgttgggggaggtcgacgaggagaccctcacactggcggacaagtatggcatcgtggtgattcaagctaggtcttggatggagatcatttacctgagtgaggtgttggacacacctctgctgcctcgtctgctccctccccagaggccaggcaagtgccagagggtttacaggcaggagctgggagatggtttggctgtggtatttgaatgggaatgtacaggcacacctgccctcactgtggttctcaggggagccaccacccaggggctgcggagtgcagagcaggccgtctaccacggcattgatgcctatttccagctatgtcaagatcccagactgattccaggagctggggccacagaaatggctttggcaaaaatgctttctgataaaggaagcagattggaagggcccagtgggcctgcattcctagcatttgcctgggccctgaagtatcttcctaaaactttggcagagaatgcaggcttagctgtctcagacgtgatggcagaaatgagtggagtgcaccaaggtgggaacctcctaatgggtgtgggaactgaagggataataaatgtggcccaggaaggggtgtgggacaccctaatagtcaaagcccaaggatttcgagcagtggctgaggtggtgctacagctcgtgactgtagatgaaatcgtagtggccaagaaaagtcccacacatcaggagatctggaatcctgactctaagaagacaaagaaacacccacctcctgtggaaacaaaaaaaatccttggattgaataactagtgataccctcaataaaacagggattgccaagaagggaacaatcaccccaaaaatgaatgtttgcctttattccgtgtttggtacttgattcactttctttaaataaaaacatgaaggaacataaa

SEQ ID NO: 411493 - DNA, 221 bp, Homo sapiens
tctttccatcgtgttccactgtcccagccacacacacaccagataggaagactacaagcaacctcaaaaggtcttttcatttgttcagcatttgaaacttcttcctgacaccagaagggctcttcttagctgtctttttcctgggttattcctggtaaactagctgacttttgtttcaaagcatatgtctgtaataaagtgccagtctctcttatttgctt

SEQ ID NO: 411494 - DNA, 284 bp, Homo sapiens
gaaagaggtttaattgactcagagttccatatggctggggaggccttgcgatcatgcagatggcgaatgaggagcaaaaacacatcttacatggtggcaggcaagagcagaatcttattctaggttagagaaaaaaggatccttcagcagctaaggtgaagataccatccaggatgcagaaatgggacctggaaagactccgtattccttttagggaagaaaaggtccatctcgaattacctcattgttcagagaataataagtatttgttcagcaataacaat

SEQ ID NO: 411495 - DNA, 429 bp, Homo sapiens
cagatactgctacgtcttagagatgcaccaggaaacagtggggacttattttaaatggaataatcaaggaaaggttttttgaacccattttaagctgaggaaccaatcggtgcaaacctcagaggttctaaagtgtagggcctttggtgttctgggaactgagagtaggccaaaagcagtgctgcgtagggtcttgccatctcaactctcctactggctttagaatagagactcttaagtaacgagatggtcctatcttatatgttacaataataatgttaatggttttaaactattttagactttcagtctggagtaggttctgtgtataacatgtttctactgtttttatattttggtgtttgggcaaatagtgttatgtcctataggctttaggtaaaactatctaataaatcattaacaattatg

SEQ ID NO: 411496 - DNA, 340 bp, Homo sapiens
ctgggcctaacctctcaccacatcacattaccctgaacatgtgtaataaagctgctgactccatgattggcatttggccactgacaacctccccaggttcactctctgcgtgtgccccttccccaatcacctgtgtgacccaataagagaaatgcctggacactctgtggatttcaaatagcacagcctctagacagtgctgaggaaactccaccctagtgacaccctcaaatcgcccatgtggcttcgctcttgcttcattccatactggacctgagcctttctcctcggggaatccttttactgttaactgtgtaatacatttacttcatattcatca

SEQ ID NO: 411497 - DNA, 355 bp, Homo sapiens
ctccccacgcctgcccccacactcgctagcccgccgtcccctcttcctgcttccgtcctccacagcagtcatcaccatctgatattcctgtgtatgcatcggtttgcctttctggctcctggttttgctctgcctccccgctggaaggtaagctctgtgggagtagagcagggacttgtttgcattgtttattccgtgacccagccccggttctgtgtctggcacatagaagtgtcgctgaatgaatgaatgaatgaatgtccattgtgtgaatgaaagagtgacaggtttggaggtcactggagcagatggccaagtctgtgacagctgtgataataaacagtgattacaagca

SEQ ID NO: 411498 - DNA, 332 bp, Homo sapiens
tagtctcaagtttgttcaaagctggactcctcgacttggaaccaggagcagctggagatttgtcaatttagagctcatttgccacgggagacgctcttggtgtccccagcaccgaagggtaggtcaactctacagttttcctgaacatgataaggtgtgtgaagacgctgtgcaaattgtacagcgctctgcttaaggagaacctcgatcttcatctcgcccccagaacttccctcccttgaaaataaaactcccacctgaatgtaaagcccaggagggggttttgttaaccgcacttattcccaaagcataaaggaatgtctaataaaaaa

SEQ ID NO: 411499 - DNA, 201 bp, Homo sapiens
tggccgcccactcccacacagctgtctggcaagaacctcctgacagcctggaataccctcgtcgtcgctaccgacggctaccaccttcacctgtacaagcccttccctgtcaaagtaaaggttgcagaaaaccttccctgattccatggtaggcactcagtaaataaacaggcaacctcaagttatttcttccactcattg

SEQ ID NO: 411500 - DNA, 978 bp, Homo sapiens
attctggtaaccgttcaagccctgtcagtccggtaaattgggttaacttagcaactcggtggtgcaaagcctccccaaagacaagaccgcattcagggagaagagaaccagcctcatgcctgagccgatctttcttcctttggttgtcctccttcattattattctgcaatgcgcagcaatccctgtgcgtgcccctgtgtcagccccttagctggtcactccagcggggctgggagaagaccactttggctactcagatggcactatgctgtttaatttcttctgctctctccctcagagtctaactaagcccttgcagcacttgagccgggggctgccctcctgctggcctttccgtcgtcgttgaacggatctgggggacggggacgttgcagaggagccacaatccccactcgttgtttccccaatgtgctttccgaactccccgagtgcgtcttagataagttatttgagtgaggacagcgctgcggtccgcctggagaaagggagcttcctccgcacttctacttcatcgtgacagcagtggtcgcagcgccactggccatctggagtcctgggaacattaaagcgctgttacccgccaggcgtttccgcctaggacacactcacacccaccctcggagactcctaaaggtttctccgtgtcaattcatgtgtcctcctcccagcagcacacacgcacacacgcacatcaacagccaagtcagccacccagtttcaacttcgggttgtccatgaaaattcagggaggctgatcttcttgaagaaattaatgagtattcccacaggaaatagatgtaagggaggggcgcctgtccaaactacagcaggagggggccctgactcaaatacaaaggttacctttcagtgggtttctcagtcttgctagtgttgggggaagggttttgataatggttttgtctaggtgggtttttgtttgctgttattattttgaa

SEQ ID NO: 411501 - DNA, 333 bp, Homo sapiens
agaaaactcttttcaaatctccttatcatctgattccttttttttggtgggggtggggttgggggggcactgtgtagtctccataacactgaacccagtgtgccgccagtcttcccactagaccgaaagttctctgagtacagggggcttgcaactcattcttcgatcttcagtgcctggcacatagtgggtgtatactattttttgaatagtatacaatgtcaataaactgtaattcactaatttgttaggctattgtgtgtttctctctgaatcccttaaaggcagggatttttgtctgttttgttcactgatgtaccctaagaacgtaaa

SEQ ID NO: 411502 - DNA, 215 bp, Homo sapiens
atttgtttttcctgaacacttaatatgttttctgacttgaactgtcagaatctaaatttagaaactctcatttggtatatttcatgtccatctttgttccatataattacaaaaatatcttagagctgggtataaccttaaagattgtcaagtccaatcttgtggtttttcaaagaaaaaaaacggatttaaaaaaataaagcaagtacctcatg

SEQ ID NO: 411503 - DNA, 770 bp, Homo sapiens
aggtggggtcagacaaatctgacttcaaatcctgactcatgggcacttccacccttgagcctcactcaggatgtgcatctgtaaattggggataataaataacgatctctgtatttttaggcctctgagttgtcccagatataacacacatgtgacccagattatacaaaaattgatggggaatttatgtgcaggcaccaaggcatcaaatagagatgaaggtggcctcagggactctgccgggatgctttgctcctctctcccgtgatcttcattccgttcttgggccaataattcagttcagggcagaatatgggctgcctttccttagagaaaatatcagatcaaggttaggggccgccatattcccaggggaaaggactctgattggctcagcctgggtcagatgactatatctggacccaatcaggctaaggacagggaagtaggtctcagggggcagacatggctgtttccactgtggccacgtgaatggaagggagaagaagttcttacaaaaggagtggatgtcagagaggcaaatgggcaggaataaaagagatttgtttctgctacaacatagcaacattgtagcagagtatagcacaggctgtgaaaccagactcctggggtcaagagtgtgctgtaatcccaactactcaagatgctgaggcaggagaatcacttgaaccagggaggtggaggttgcagtgagccgagattgcgccactgcactccagcctgggcaacacagcaagactccttttcaa

SEQ ID NO: 411504 - DNA, 506 bp, Homo sapiens
  misc_feature (468)..(468): n is a, c, g, or t
  misc_feature (474)..(474): n is a, c, g, or t
  misc_feature (501)..(501): n is a, c, g, or t
aggtggggtcagacaaatctgacttcaaatcctgactcatgggcacttccacccttgagcctcactcaggatgtgcatctgtaaattggggataataaataacgatctctgtatttttaggcctctgagttgtcccagatataacacacatgtgacccagattatacaaaaattgatggggaatttatgtgcaggcaccaaggcatcaaatagagatgaaggtggcctcagggactctgccgggatgctttgctcctctctcccgtgatcttcattccgttcttgggccaataattcagttcagggcagaatatgggctgcctttccttagagaaaatatcagatcaaggttaggggccgccatattcccaggggaaaggactctgattggctcagcctgggtcagatgactatatctggacccaatcaggctaaggacagggaagttaggggtcttcagttgggggncagacntgggcttgtttttccactttttggggnccacg

SEQ ID NO: 411505 - DNA, 490 bp, Homo sapiens
aaacagctattagagaccagagtgaacagaacacacaagaagactcagagaagccagaggaggccattttacctgtttagttttgtggcaggggtgtagagctcttcctttcaaatcatttcctaacgttgtcatttgcctattttctttaactgaattgtgaattccaatcttgcctcatgccaggccccatacatacatacataccaccttcctttcaaggaaaatctaaaggaaggaataataaaaacaatgttagttgccaggtcaaagacaaattgtagaaaggctaagataggagggggaattgctcatgtctaaagcagtggcgatttttaacatggtttttattatcagtttgaactctacaaagttgccaatacttggccatctaggatcagcataatcaataacttcctaagaaggaacctgacggtacctatccccactgcagggtgctatttaagcctcagcacagcagagcagaaag

SEQ ID NO: 411506 - DNA, 244 bp, Homo sapiens
aatttctcagcagcattccttttggcttgcttttttgatgccccctttccagtttccataaatgactctagcctgcaaattgtagtatattctctcttatgagcaggtcctccctcctgggaaagggtatattcaggaagtctccagccatgatgaatagccaattcctgtaatgaaccaataagattaagctggttctttggttgcttggaagggtcaggcattaaggggtcaggaactgcaa

SEQ ID NO: 411507 - DNA, 1428 bp, Homo sapiens
ggggagctatgaaccttaagattagactactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaagaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 411508 - DNA, 1192 bp, Homo sapiens
ggggagctatgaaccttaagattagactactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 411509 - DNA, 777 bp, Homo sapiens
gcacgaggtctcttagccaaggatatgttggacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 411510 - DNA, 1905 bp, Homo sapiens
ggggagctatgaaccttaagattagactactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtatccaccaacccctcctccaacatcgatccaggcgactatgttgaaatgaatgattcaatcacccacctaccctctaaagtggtgatacaagatattactatggagctacactgccctctgtgcaatgattggttccgagacccactgatgctaagctgtggccacaacttctgtgaagcctgtatccaagacttttggaggctgcaagcaaaggaaacattctgtcctgagtgtaagatgctatgtcagtataacaactgtacattcaaccctgtactggacaagttggtagagaagattaagaagttacccttactcaagggccatccacagtgcccagagcatggagagaacctgaaactgttcagtaaaccagatgggaaactgatctgctttcaatgcaaggatgctcggttgtctgtggggcagtctaaggagttcctgcaaatctctgatgctgtccatttcttcatggaggagcttgccatccaacagggtcaactggagacaactctgaaggagcttcagaccctgaggaacatgcagaaggaagctattgctgctcacaagaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttta

SEQ ID NO: 411511 - DNA, 458 bp, Homo sapiens
caaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggtgagtgaccctttttttttttaacttagcagggcttctaggaatagtgtggaaaacaggatcatagaagaggatatggatttaggagcacaaaaggaaattcatgaagggaagtatttaacttgtgacagctggtagctactatactctctccaagccttggaataactgataatttatactagagaagctggtaggaaagtaatgaaatccaccaaaacattttgaga

SEQ ID NO: 411512 - DNA, 408 bp, Homo sapiens
cattgtaaggtttatataaagttgaagaaattgaggctcagagaaatgacatagcttgacccaaagggacacagcctggactggatcccccatcttgggacctgagagcctcgacttaaccacagcaccgggacattttgtcattaaaatggaagcaaatcaggtcctggggccttaagaacacaccagctttgcccacaggtctggggagggccttgcaggggatgcacccagccagcagggcccctgcctgctcgccgactcagtttattcacatttcttgataactctctggcttcttttttgccctagggcttactttgtttatttactttttatacctgtatatggtagaaagaaaacataaaggaaaagcgtgtaatttctacataatgtttggcttgtaaa

SEQ ID NO: 411513 - DNA, 1001 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggcattccctccaggaccattgcaacaccactgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtag

SEQ ID NO: 411514 - DNA, 920 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggcattccctccaggaccattgcaacaccactgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtag

SEQ ID NO: 411515 - DNA, 519 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactg

SEQ ID NO: 411516 - DNA, 642 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactg

SEQ ID NO: 411517 - DNA, 453 bp, Homo sapiens
agagcccccacggggccccggtgggggtctcatgcagcatctgacccgccctctcctctcctggggcatcccctcggcagcctcagcctggcctctatctgcactggtgttgctaggtgactctgaggggattcccagagtgtctcatccttcgtgtgggcaggtctcaggagtggccagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgca

SEQ ID NO: 411518 - DNA, 453 bp, Homo sapiens
cagtgggatgctgacgtgacttggtctcttctggtcagatccccaccatgcaggacaccagggattagagttgtaccctgcaccctggggaagtcaccaaactcagatatcaggactgtgtagtgactgtcagaaggctgaccccaaactctgagatttcaatcactcccaggaattccatggcatgagactgccatcagagtagcagagaggccagactttgagctcacaaagcccagggtagacaccattaatgggctgggcaccagaagaccctccacgagtgtctgccatgcatctgaaaataggacatgacgctgagtggagagacagcaagaaggctctggaaatttttttgccagcttaacagataatgtacatagaattagattcaacttgagttatagagaaaataagagataaaataaagaaatgtaacattctttgcttatc

SEQ ID NO: 411519 - DNA, 295 bp, Homo sapiens
tctgtctgccatgctccttttccactcatttgttctttcagtatgtattgagtgcctactgtggaccaaggccctgtgctagaagtggagaagcagagactaataaaacaatacaacaataaaaaaaattacaaataaaagacctggagccttggctaaatcttggcacctgggtgaactcccctgggtgagtcagtggagttctgatttgcatttccccatggctaatgatgttgagcaccttttcatgtgcttattggccatttgtatgtcattaaagaaattaattttgttt

SEQ ID NO: 411520 - DNA, 427 bp, Homo sapiens
tttctctccagtgtcagtcaggatctttgattttggagcacaagccttctgcgtgctactgactgggtcctggcctccctccttccatggcatcgtcgtgaatgggaatttccaccactgcctccattagtcagaagattgaacatgttgtaactgtagaaagcccgtcatccttgtgtatgcacttgctgaaagatccactgaagagcaaccttcatgaacattaccaggggacttgtgctcctataaaacgcactgttttcctcactgcgaggtgggtctctcaccgcgatggactatctgtgatcacagagcacttcttccctgggccttccctgtcacactgatggtgtgagtatgtagggcaggggtgggagtgaacatgttaatctcttttgaataaactgattttgaagtagatgtctca

SEQ ID NO: 411521 - DNA, 476 bp, Homo sapiens
gaatcagctggctggaggaattttggaaggggtgaggcatacactttcttctatgttcctgaaaccacaacattgttaggactcatctgttcatgagaccagaccaatagaaaatgagcacttcgtggataaaaaatacagatggaaacttagtgaaatgtgacctccagtgctggagatggacctaatgggaagtgtttgagtcatgagagaatatcctttatgaatggcttggtgccttacctgtggccatgagttactacaagatctgattgttaaaaaaagattctaggacttcctgtccctctgtcttactcctcttttaccatgtgacatgcctgcttccccttcaccttctgtcatgattgtaagcttcctgaggttcccatcagaagcagagtagttgctggtgtcatgcttgtacagcccatggagctgtgaaccaaataaacttcttttctttataaattacctag

SEQ ID NO: 411522 - DNA, 655 bp, Homo sapiens
tttttcatgtccttagatactgtttgggcaacagagggtagaatttattatatgtatcatgattacctaaaaccacttaccaaaaatgaacagcttacttttctcaccaaaggagcgttgcctgctatccttcaaaatgctttaagccccttagagtataacataaacaaaaggtggtagtattcctaaatctgtgttcttatgttatgcttgcttatttccataacatttgtaactgtaattaaaagaatttgcacattttcactcatttacacaacttttaaatttattaattcttaacattcttccgcagagcaagtcattaaataggattaactgcatgaatcaccagttgataagcaagtgcagaacttagacaagaagcagctcaataatgtagttccagaaacctaccattatctttctatttgtgagcatgatgaatttcaaaataaataggatagactttttgtaagatcatttgttacatagctacatacatgcagtgtctttcaagaatacttggggcctgccaatttgtgtctagtatctcataattataatgttactctgaaaagagagaatacatatgtatgtttacatttgtgtatatatgagcttttgtcagtcacttgaaactcagacaaaaaaaaga

SEQ ID NO: 411523 - DNA, 587 bp, Homo sapiens
aactaaatataattctagatcattttaagtatcatctgtgcactcacgcaatatgtgcatggaacgtggaggcgagagtacaaaaggcatggtgcttgcctatcgacatgaggcccctacaacccagggaaggcccggtggtccaggatccagtgctgctccccatgtgcccatctcacatgctgctcggcaccagcagccatcaccactccacttctctcaagagacagagtcttgctctatcccccaggtgggagtgcagtggcatgatcttggctcactgcaacctccccctcctgggttcaagtggttctcctgcctcagcctctcgagcatctgggattacagatggaggaaggaggtcccaagccaaggaatgcagcatgggcctctagaagctggaatgaccctcacctcacggccagcaagaaatcagggaactcagtcttacccgagtgagcaggaaatcgattctcctctgcagcctctatagagaacacagcctgtcaacaccctgattttggcccaatgagccctgtacctccagaagtgtaacgtaataaatttgtgttgttttaagctaaaag

SEQ ID NO: 411524 - DNA, 465 bp, Homo sapiens
aactaaatataattctagatcattttaagtatcatctgtgcactcacgcaatatgtgcatggaacgtggaggcgagagtacaaaaggcatggtgcttgcctatcgacatgaggcccctacaacccagggaaggcccggtggtccaggatccagtgctgctccccatgtgcccatctcacatgctgctcggcaccagcagccatcaccactccacttctctcaagagatggaggaaggaggtcccaagccaaggaatgcagcatgggcctctagaagctggaatgaccctcacctcacggccagcaagaaatcagggaactcagtcttacccgagtgagcaggaaatcgattctcctctgcagcctctatagagaacacagcctgtcaacaccctgattttggcccaatgagccctgtacctccagaagtgtaacgtaataaatttgtgttgttttaagctaaaag

SEQ ID NO: 411525 - DNA, 316 bp, Homo sapiens
  misc_feature (64)..(64): n is a, c, g, or t
  misc_feature (76)..(76): n is a, c, g, or t
gggaggtcccccgctcctgggcaccgcccgggccctccgtccttttcccccccctaatttcgtntagaggagtcgncatggaggaaggaggtcccaagccaaggaatgcagcatgggcctctagaagctggaatgaccctcacctcacggccagcaagaaatcagggaactcagtcttacccgagtgagcaggaaatcgattctcctctgcagcctctatagagaacacagcctgtcaacaccctgattttggcccaatgagccctgtacctccagaagtgtaacgtaataaatttgtgttgttttaagctaaaag

SEQ ID NO: 411526 - DNA, 315 bp, Homo sapiens
gagtggagacttcaggactcaggcctagcaggggaaggttgtggctcatgaacccctgcttacagcctggcaccctcctactgcaaccgtgctctacggacaggttttcatcattcatcctcatgttccacaaggtgttccagaaatcctctgccccattccacacacccaccgcagtagcctggtcaagtgatttcaagtgggtcctcaccactaaaaagaggaagatggacaaacttttactcgcgtccttgtgaagagcccaccaaacaggctttatgtgagcaataaagcttttaatcacctgggtgcagt

SEQ ID NO: 411527 - DNA, 903 bp, Homo sapiens
aaagatcttcctcattgtcttttctggaaacatttaaaaaccagtttaatcagaaccaaagacagttttattttctactgaaagaaaattaacatttcttatcaatgttagtgggttgtggtaaggattcactatccccactgtttttcattaatggccaagtttgtttctgacttctcttttgcttaatcccctgtggaatagagtcaagtgcatgtttttttaacatacaactattttctctacaccccaggaaatgtgaactgtgtgtcacatccagtaaaacatggtgcctccaaccatggagtctgctttatttgaacatttaatttttgcttttcagagtgttataattttacctttcttgttcaatctaaggcagaatgagtggttcttttgagtctccttattctaatattagatttcccaaactaaattccctctttactatgcacaattctagatttaaatatgatgtaaaaaattctactgtctttgtgtgctgatttaatgtatctcctgtgttaaaagcaagattgaaaacggacatgcagatggacacagccaaagaatcaatgagcttgaagatatggcagtggaaacttcccaaactgaaatggaaagagaaaagagaagaataatgcaaaagtcaatatacttttaaaggaccaggataaaaaacaaaacaaaacaaaaaaaacacccaaccagagcagaacatctaaaatctgtgggaacagtatcaagatgtgtatatgtgcaatcaggaataccagagggacaccaaaccacagattccgaagcacagaaaataacaagcaggataaataacaaaaggctacacttacacatattatagtcaaactgcgacaaagagaaaatctgtcaagaagccagagtaaa

SEQ ID NO: 411528 - DNA, 2565 bp, Homo sapiens
  misc_feature (661)..(661): n is a, c, g, or t
gaccaggacgcggggaggacggaccagcaggacagaccgaccgggggcccggcgggcggagggcagcgcagccacgtcccccctggatccgccgtcagccgggcccggggctttcgacatgccccccaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctacaccggccgcctggctgacggcgcagaggcggctgcggccgcggccgtggccccgggggctgagccgagcctgggcgccgtgctggccgccgccagctacctgcagatccccgacctcgtggcgctgtgcaagaaacgcctcaagcgccacggcaagtactgccacctgcggggcggcggcggcggcggcggcggctacgcgccctatggtcggccgggccggggcctgcgggccgccacgccggtcatccaggcctgctaccngtccccagtcgggcctccgccgccgcctgccgcggagccgccctcgggcccagaggccgcggtcaacacgcactgcgccgagctgtacgcgtcgggacccggcccggccgccgcactctgtgcctcggagcgccgctgctcccctctttgtggcctggacctgtccaagaagagcccgccgggctccgcggcgccagagcggccgctggctgagcgcgagctgcccccgcgcccggacagccctcccagcgccggccccgccgcctacaaggagccgcctctcgccctgccgtcgctgccgccgctgcccttccagaagctggaggaggccgcaccgccttccgacccatttcgcggcggcagcggcagcccgggacccgagccccccggccgccccgacgggcctagtctcctctatcgctggatgaagcacgagccgggcctgggtagctatggcgacgagctgggccgggagcgcggctcccccagcgagcgctgcgaagagcgtggtggggacgcggccgtctcgcccggggggcccccgctcggcctggcgccgccgccgcgctaccctggcagcctggacgggcccggcgcgggcggcgacggcgacgactacaagagcagcagcgaggagaccggtagcagcgaggaccccagcccgcctggcggccacctcgagggctacccatgcccgcacctggcctatggcgagcccgagagcttcggtgacaacctgtacgtgtgcattccgtgcggcaagggcttccccagctctgagcagctgaacgcgcacgtggaggctcacgtggaggaggaggaagcgctgtacggcagggccgaggcggccgaagtggccgctggggccgccggcctagggcccccttttggaggcggcggggacaaggtcgccggggctccgggtggcctgggagagctgctgcggccctaccgctgcgcgtcgtgcgacaagagctacaaggacccggccacgctgcggcagcacgagaagacgcactggctgacccggccctacccatgcaccatctgcgggaagaagttcacgcagcgtgggaccatgacgcgccacatgcgcagccacctgggcctcaagcccttcgcgtgcgacgcgtgcggcatgcggttcacgcgccagtaccgcctcacggagcacatgcgcatccactcgggcgagaagccctacgagtgccaggtgtgcggcggcaagttcgcacagcaacgcaacctcatcagccacatgaagatgcacgccgtggggggcgcggccggcgcggccggggcgctggcgggcttgggggggctccccggcgtccccggccccgacggcaagggcaagctcgacttccccgagggcgtctttgctgtggctcgcctcacggccgagcagctgagcctgaagcagcaggacaaggcggccgcggccgagctgctggcgcagaccacgcacttcctgcacgaccccaaggtggcgctggagagcctctacccgctggccaagttcacggccgagctgggcctcagccccgacaaggcggccgaggtgctgagccagggcgctcacctggcggccgggcccgacggccggaccatcgaccgtttctctcccacctagagcgcccctcgccagcccgctctgtcgctgctgcgcggccctggcccgcaccccagggagcggcgggggcggcgcgcagggcccactgtgcccgggacaaccgcagcgtcgccacagtggcggctccacctctcggcggcctcacctggcctcactgcttcgtgccttagctcgggggtcgggggagaaccccgggacgggggtgggatggggtaagggaaatttatatttttgatatcagctttgaccaaaggagaccccaggcccctcc

SEQ ID NO: 411529 - DNA, 326 bp, Homo sapiens
gggccaggcggccagggcgccgcacggctctcacccggccggtgtgtgtccccgcaggagagtgtgctgggcagacgatgctggacacgatggaggcgcccggccactccaggcagctgctgctgcagctcaacaaccagcgcaccaagggcttcttgtgcgacgtgatcatcgtggtgcagaacgccctcttccgcgcgcacaagaacgtgctggcggccagcagcgcctacctcaagtccctggtggtgcatgacaacctgctcaacctggaccatgacatggtgagcccggccgtgttccgcctggtgctggacttcatctac

SEQ ID NO: 411530 - DNA, 267 bp, Homo sapiens
gtcgtgctctcctgcagcgcacacgctcactttctcacgctcgctccctcccggcgccgctttctgacgggcgaacaagtttatatttaccatgatgtttatttgatgacaccgtgaagaaaatgtgcaaaatgaggccctaccatgttttaaaaaatgttttcatcaaatggatctcagagggacatgcccaaaactcctgctaccagagtgatcctctcttcatctcttttctctagccaataaatcaaagtttcatttctcaaa

SEQ ID NO: 411531 - DNA, 419 bp, Homo sapiens
tatgatccttgacatttcaaatttatattgctgttattattttttgtgataatttgtagagctgaagtttgtcaagtttgtataatgcatttagcgctgtagttaagagcatgggctatgaatggatgctaatggagagcctgttgcaatgtaaaaaagacactcaagtagctcagtggaatggcccacatgatgagaaactgagagccagcgtcaactgcccatcacataattaagcaagcttggtagcagaccttcttgctccggtcaagccttcagatgactggaaccccagctgacaactccactgtaaccctatgagagctgccaagctagaatcactcagccaagccactcctgaattctggatccccagagtctgtgtgagataataaatgttcattgttataagccacaaa

SEQ ID NO: 411532 - DNA, 890 bp, Homo sapiens
tttgggaggtaccttaaaatgaaaagcaaagaaacttccatgcggagattgtcttgtttttctcaaaatgggataattttgcttaacataagtagtatcccttccttcctttccatactttgagaattaataaggactagctttttgatcacacagcttgataaaattttcaagggtccaaattactgtctaaaccatttgccactctttgtgtatatttgtcaaaatctgcttttctatatcaaaacttttctctcaagacctgagggaattaattaataaggaatccttggaacactggaaattctaaaataagagtcagatacaaaacactggtcactaaaattcttacctttatgtattagaatggcaatcaatgaacaaactgaaaatgtctttggatattatttctgtttattttttgcctcaaaattattaaatgacatgaaataagtgctcaagaagaaaaataaacaattcttcatttcctgttctctagttttccgtattacctggaaaaaagaaaatttgttggtcactttaaagataatataaacagctgaacatggtgcacaccccgactccccaccccactcccatgcctgtaatcctagcgctttgggatggcaagatggatcacttgagtctaggagtttgaggctgtgatgaactatgattgcaccactgcactccagcctaggcaacagggcgagatcctgtctcaaaaaagaaaaaagaaaaacagagcggtacaattactgtctcccaaaagattatttccattattctagattcaccagtcctccatacctcttttctttttattataaagctgaacaggcactagggtactgattgaactaagtggaaatcaccaggggtccattgct

SEQ ID NO: 411533 - DNA, 438 bp, Homo sapiens
ttagttatttctgaatcctttaggagttttctcctcaaatacacaaattgtcttgcatcaacttcatttacatggaccagtttcctggcccccagaagcctcagaccctgaacattgcactgcgctctgcccctagctctccagtaggtggcggtgggtaggcgcagaagcggcctgtgttaggttggtgctggcctgtgcctggggcctctctctgccttttcttctgaattagaaggagtttcctcttggagcaaatagctaatttgcttgcttttgtgttgataggaggagcacagccaaattctttttactgatagataaacacgtgtttctatcaattaagcttttaattctcagtgttttatttttccattatattccaatcagtaatgaaaactgctacaattacattaaagaaaaatggttcttttggca

SEQ ID NO: 411534 - DNA, 1048 bp, Homo sapiens
tgatccccagccacacaggtcgggttaaatggctctggctcagtggcaacgcctgtgcagtaaccgttactgcttgatgacccccaaaccaggtcctgcaaagctaccccctactctctcaacagtcttaggcccacctgcacccaggtgaaataaacagccttgttgctcacacaaagcgtgttgctggactctcttcacatggacgtgcgtgacatttggtgccgaaacctgggacaggaggactccttcgggagaccagtcccctgtcctcaccctctgtgaggagatccacctatgacctcaggtcctcagaccaactaacccaaggaacatctcaccaaattcaaatcgggaccccactggaaatcagactgtccaacttgcctggcagccactcctagagtccctggaactctggcccaaggctgtctgactgacttctttccagatcttctcggcttagcggctgaagactgacgctgtccgatcgcctcaaaaacctcctggaccatcccggatgctttgggtaactcttacagtggaggacaggaatgtcaggcctctgagcccaactaagccatcatatcccctgtgacctgcacgtatacatccatatggcctgaagcaactgaagatccacaaaagaagtgaaaatagccaattcctgccttaactgatgaaattccaccattcctgccccaccctaactgatcaattgactttgtgacaatacaccctccccgcccttgtgataatgtactttgtgatattcccccacccttgtgaatgtactttgtacaatacaccctccccacccttgagaaggtactttgtaatatgctcccccacccttaagaaggtactttgtaatgttctccccaccctttgtactttgtaagatccaccccctgcctgcaaaaaattgctcctaactccactgcctatcccaaacctataagaactaatgataatcccaccaccctttgctgactgccttttggactcagcttgcctacacccaggtgaaataaacagccttgttgct

SEQ ID NO: 411535 - DNA, 456 bp, Homo sapiens
ttagaggtgcaggagatcagtagtagctcaggagctggacttttcatgacattccagactttagtgagcttcttctcaaagctcttcttaacactgcattctacacaccctctacagccatgctgaatatcctctggtttgctgacttttgcatagaagtgtcaacaaaccattagccttagctgaggctcctctttgagtccagctgttctgtgattatatagatcttcccataaggaggaggcgattgtcctctactggaggagtttggacagcaatctgaccccaattgagcagaacatgtttctaagcatttttcacttgtgtacttgttcattcaacaaatctttattatatccagagcctaatgctgagccaagcggtaggctacagagatttaaagaaaagaaaaaacatggtctctaccttttttaaataaattgacatgaaattgta

SEQ ID NO: 411536 - DNA, 823 bp, Homo sapiens
ttagaggtgcaggagatcagtagtagctcaggagctggacttttcatgacattccagactttagtgagcttcttctcaaagctcttcttaacactgcattctacacaccctctacagccatgctgaatatcctctggtttgctgacttttgcatagaagtgtcaacaaaccattagccttagctgaggctcctctttgagtccagctgttctgtgattatatagatcttcccataaggaggaggcgattgtcctctactggaggagtttggacagcaatctgaccccaattgagcagaacatgtttctaagcatttttcacttgtgtacttgttcattcaacaaatctttattatatccagagcctaatgctgagccaagcggtaggctacagagatttaaagaaaagaaaaaacatggtctctaccttttttaaataaattgacatgaaattgtacgtatttattgtgtacaatatgatgttttgaaatatatacataccttctagaatggttatatcaagctaattaacatatgcagtacctcacatagtatctctgcagggaaggcttatggcctgggcaatttttagttctgagcaagatggcctggaccttagcttgctgctgctagtagattactgggagtgtcagatctgtcttgtcatgttaatgagagctgggtgggacttactgccacctgctactcttactccttgtgcgaactcttctgtacagtagaaacagctatgcttctccttggaataatatcccagtggccagagaactgtcccttgagctccacaggggccgctgcttgccgtg

SEQ ID NO: 411537 - DNA, 464 bp, Homo sapiens
tttattattgttttcatttacagaatgactagacagaaaatacttccttagttctgtaacaagcaatgattcctggagtgggaaatgttcttgtgggaccagagctcagttgcagcctttgcagactaatgctcctgatattaacaagaggtcttgtgttaacccaacgatctaactccagcctggtgaacctgatctttggaactattaggggggaagataaaaagccagggaactggggagatgccaaagtaatcactttctgcttgctcaagtttgcctgcagttttcaattggatgcagtgccttccatttcccaccctacatttttgcagagctgtgacactgtacttcagagaagagctacaaatctacatccacatgctggcagaaatccagaaggatgcacactcagtcatgacagcatctacgagaccaggatggtgggcttctgattaaaggat

SEQ ID NO: 411538 - DNA, 341 bp, Homo sapiens
tttattattgttttcatttacagaatgactagacagaaaatacttccttagttctgtaacaagcaatgattcctggagtgggaaatgttcttgtgggaccagagctcagttgcagcctttgcagactaatgctcctgatattaacaagaggtcttgtgttaacccaacgatctaactccagcctggtgaacctgatctttggaactattaggggggaagataaaaagccaggtgagacagagctgtgagggatacccaggagtcagaagaatcctctctcctcagctagacatagtctaaccgacttccacagacacaaaaataatttactctcacaccac

SEQ ID NO: 411539 - DNA, 476 bp, Homo sapiens
atgagtaagttctagagatctactgcacaacactatacctatatttaacagcgctgtgttttacacttaaaaatttgctaagagattagagctcatgttaaatgtttctaccacaataaaaaatattgagaaaccaaaatcaaaaagaaaaaaaaaaattttgttagctaaaatcaaaaacaaaatttattcaggttcatacattctagttactgtagagttctccagtcattaacatagtgactatatgtgtcttctgtagcaaggttttaacaccattatcttttgacccatttcatagtatcagaagtaacatattagaaaggaatggagtcagcatgctagaggcagccacacagaaagtggaaacaaatgatggctaaagactgacagagatagaaattattcattcagcaaatatttgctgggtactatgcgccaaaaactggttttggtcacagagatatggatgtaaa

SEQ ID NO: 411540 - DNA, 289 bp, Homo sapiens
cgttgctatttctttgtaaaacttattgtattattttattgttatttgttatcttttttgaacattttgatctgcagttgattgaatgtgtggatatagatctcacagatgtggagggctggctgtgtacacacacagggagaagactgtatgaagataccagcaaaaggcagccatctacaagccaaagagagaagccttgggatgaactaatcctgctgaaatcatgaccttgcatattttgcctctagaattgtgagaaaataaagttctgtgctttaaggcaccc

SEQ ID NO: 411541 - DNA, 576 bp, Homo sapiens
gagagtgacatcaacctgtggattagatcaccaaaaaagcaatcatcttattccaatggaaagaaattccctgagttaaaaatgatcaaaaatgaatcagattatgtcattgtctgagaacttgggaaggtgtagtggagctgcagccactggctgagcactgatgaatctgcctgtacttctttgaatcagctgtcccacctattacaagccccaaatgaatttctcatgtggatatgaattgtagaactccggcttctaaaagagttctaaattcatgtgaatggccgccatggttcttaatcaccatgagtttgactctatgaatatgatctgagggaagaaacattagcttcattattgcttattaacaatgatgatataatgataataacattggatagcatctatttccaaacttcttagcagctatcatcggtaccgtggagggaaattttattttttaaatcattctatcacacacttgcattcattacatttcatatattgagctctctgtaatattgtctgctttataaacaataagcttattaaaaagaaaattgttaaataact

SEQ ID NO: 411542 - DNA, 488 bp, Homo sapiens
tgctttcagatgttgcaaattcatcccacctcctgctgcagctatgatactcagagaaacgttgggacgaggcctgcagaggatgtgttctgggtatttggtggccctgctggtgagcactggtgttccttgaggtcaacctgtgctgaggacaggaatatttcacccaagtacataactaagagaagatcactcccagaagatttcatccccaaaagcaagaaggtgaaggacacttgtacccagacagtgagatccactgcctccttgccatgcttttagctccccccacagctgagccctcctgaccagaaaacctgacggggccaccttcttcatccctcagtctcacagaggtcccataaaactgaaccaggcttggtgctgacagtgggccagggcaatgtaggctcactggagctgggtgagagtgtgacagggagcgtcaaagtcaaaataaaaatataaagacaaatctctaaatgtaa

SEQ ID NO: 411543 - DNA, 351 bp, Homo sapiens
tcttatttacaaacaacactgggcaggatacccaaacaaacaaacaagaaataacttacaaaggcatgaagctgtttattgacagtaatcagctttcatcaaattaaaaaatatatatatgtacatacacagttaacgaaggcaggccagaaagagttcatctgtaggctcagcctcgctctcacaaacctccctcctgccgcccctccgcaaccatccccccgcttgggttcttaggggtactacggagcaatttacaggctctaatgcagtttttaccccctccccctccccccttaatactgaatgagatcgaatgttaggtccatgcagttcttggtcaatgttaac

SEQ ID NO: 411544 - DNA, 2492 bp, Homo sapiens
cccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcgaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtgttcaatgaggatggcacggtgcgctacttcatcgatgccagccaggaggaccaccggagctggatgacctacatcaagtgtgcacgtaacgaacaggagcagaacctggaggtggtccagatcggcaccagcatcttctacaaggccattgagatgatcccacctgaccaggaactgctggtgtggtacggaaactcacacaacaccttcctggggatcccaggtgtgcccgggctagaggaggaccagaaaaagaacaagcatgaggacttccacccggcggactcggcggctggccccgcgggccgcatgcgatgcgtcatctgccaccgcggcttcaactcgcgcagcaacctgcgctcgcacatgcgcatccacacgctggacaagcccttcgtgtgccgcttctgcaaccgccgcttcagccagtcgtccacgctgcgcaaccacgtgcgcctgcacacgggcgagcgcccctacaagtgccaggtgtgccagagcgcctactcgcagctggccggcctgcgcgcccaccagaagagcgcgcggcaccggccgcccagcaccgcgctgcaggcacactcgcccgcgctgcccgccccgcacgcgcacgcgcccgcgctcgccgccgccgccgccgccgccgccgccgccgccgcgcaccacctgccggccatggtgctgtgagcgcgcccgcgcccccgccgggccccgcgcgctcctgggtccccggcaccccggccccgcagcgcgactcgccctccagccccaacccccggcccggcgccgccgcggagccccgcgcgctggggttgcgccccggaggcggatctcaggcacccccgccttggcccgtgtcgcagatgaggacactgagggcggcgtccctcacccaggccacgcagctggtgcggctgttcggccgcctcctctgggagggggtccccctgcctggcctcgcccccgagtctccctgctgctgtagagccgggcgcccaggccggcatccccctcgtgggtggcaggagagcggacttagagcccccgagggcccctcagcagaggaaggggagtcccctcctccgccaccgagagtcctgtgcttcggaatgaagggagggcgacctccttgtccgggtgtggtcgggcgcgggggttgtgggggcgccatctcctcttccggcccctgggactggtgtcctgaagtgtcgggagtccttacgcaaccttgacatgtgcgggctactggggtccatcggcagcgggaagagacccggagagatgcatcttctgggcccttctctcctttaggccagcttacccccaaacctggctcctggggacggatgaggaaggagctctttgcagtgcaccaggcacgttgagagtggaggcacaatggaaatcctctgtgggaccccgagcaagaccctgcacctctttgggcctcagtttccccatctgtaaaatgaaggagttggaccaatgccccctccccttcagctgtgacatcgtgcctgggaaggcgaaatatacccccagccccttccaacacacacactccagcgagaggagggcaagactggaaccgctgcccgagaggttaaggtggcttctgtggccacgaagcgcttccgagctgtgcccagtcccgggaattccgcccagtctgcccacacttccctcggtccctgcccgtttcctcaaattcgggccgtgcgcgccctctggtgtcgcctctcacactttgcagtcatttaccaggattcccgtagggcgttttgtaaaataaactataatattaatgaaaagtataaaatgtatagagttttcaagaaactgcgttctacttccagaagatggtcactttaaccttgtaaatatttatctaaaatgatatttacaaaactgtaatatattattatttgattgtatatgtacaactgtaaatacatttgtacctctcttgtattctaaaataaaaattacttggaacatttatcatttagcatctg

SEQ ID NO: 411545 - DNA, 685 bp, Homo sapiens
cgccgaagctggttctacctttctccgggattcctctgagggccaaggtctggtcacccagaggctgctaatttcaaaggcaatatgagagggactggatgtttggagggggacacggggctggacatctggatccccaaacccggactcacctctcggacagggctgattccgatcggacacttccggtggaaggactgagcggcgctacacttcaagaattccgtccacagggacttgtgagtctgcgcagaaggcgggatgcctttggactacaattccaagaatccttcctgggtctcttcgggcgcagacttttcgccaaagtcctgaagatctcagggcttgaaggagggggcatcttttttctccattgtagtagtgtgtcttgctaaataacagaagggactcctgaaaagaaaatgacgttggccgggcgcggtggctcacgcctgcagtcccagcactttgggaggccgagacgggcggatcacgaggtggtgaaattgaagcccacgcagcagggttgcaactgaaacttcatctcctctgcaaaaccttcctgcattcccagacaacttttcttctgaggccttgtttgattcatccccttaccccagtggaactcagatattcaaaatggtattaattaaaaccactggctgtcattggtccatgcatggcc

SEQ ID NO: 411546 - DNA, 392 bp, Homo sapiens
attttttttctatttctgtaaaaaaaaaatgccattgggattttgacagggattgcattaaatctgaattgttttgtatagtatgaatattttaacaattttaaaccttccagtccatgaatacagtatcattccatttatgtatgtcttctttatttcatcaatgttttatagttttcagtgtatgtcttttacctccttaattaagtttattcctaagtattttattatttttggtgctgttgtaaatgggattgttttcctaattttcttttcagatacaaaataattaaacaatgtgatttgccacatcaacagataaaatccatatgatcatttcaatagatgccaaaaaagcattttatgagattcaacatccttctgtgattaaa

SEQ ID NO: 411547 - DNA, 789 bp, Homo sapiens
tagaccataacattctgtcattaattaaaatttgaaatattttgacacaattttatttagattgtatttgctgtagagtgacttaacttgtagctacttgtttttaattgtataaaatacatagaacttaagtttggattatatcaggaggaaggttatttttaggatgcagttcttttaaaaaaatcagtgttacaaactatgttatttatagaaagaatagcagagctgaagagatttagtcatcatttaatctcgggatttcggtcctcactatgctttagaatcacctgggggaggctatgtgtggggccccattcccagagattttgaatttcatttgattgggtgtgggactcaggcgtttgcattttataaatgaggcaactagttttgaaagagattgtgacttgtcaaagcacatacagccattcagtggagggagctggatcagttcagtatttccctgtatcattctgcattctacaacctagactggagttggcagacttactccataaaaggctagatgtcctatgtattaaaaaaaaaactcacataatttccatatttccatttttttgctatttctgatgtccttcacctaaagttatttattattttggagggacggaagggagactatatatatacacacacacacatgatagaagcattgccacattatgttcaagagactggtgggctgctaatgaaatcttcagcctgtagggttattccctcccctaagcaataattaaggatcagattacttccaggcccagttaa

SEQ ID NO: 411548 - DNA, 398 bp, Homo sapiens
cggagccacagagcgacactccgtctcaaaaaaaagtatattgtgctagcttgtctaagaataaacttctatactgttgggggagggctgcacctgtcaagataacctgtcaatgtagtaggaaaacaggaggggacagtaacagaaaagcacgggaaaagatggcaaggttagttaaaatagaaaagtgctcagttcctcatacctgtaatcccagcagtttagggggccaaggaaggtgggtcacttgagcccaagagttcaaggccatcctgggcaatgtggcgaaagtgtctacaaaaaaatacaaaaagaggaagaaatgatatttcacaagtttgtatcatttgtcatgatgtgactcgaatatattaaatctttttcctttgaatactgta

SEQ ID NO: 411549 - DNA, 1253 bp, Homo sapiens
cacgaggttcccttcgagggccggaaggggttaatctcaggctccggcgtctggggagaaggtgaggcggttataattattcaatatgttcccactgactgaggaaaacaagcatgtggcccagttgttgctcaatactggtacttgtccaagatgtatcttcagattctgtggtgtggattttcatgcaccttacaaacttccatacaagatgaagaaactgagatacagagaggttaagcaacctgcccaaagttacacagctattaagtgagcaagctaggatttgaacagtctgactgaattcaaaacctaggatttggaactagaagacatggatttgaatcccagttccaccactttccagcttcagtttactcctctgtaaatgggaatgatgataatacccacctcacaggactttaagggacaatacctaataaagtacgtggaaacactttgaaaaccagaaattggctgggtgcggtggctcacgcctgtaatcctagcactttgggaggccgaggcgggtggatcacgaggtcaggggttcaagaccagcctggccaagatgatgaaaccctgtctctactaaaaatacaaatattagctgggcgccatggcaggtgcctgtgatcccagctacttgggaggctgaggcaggagaattgcttgaacccaggggtggggggtgcggaggttgcagtgagccgagatcatgccactgcactctagcctgggcaacagtgtgagactccgtctgaaaattaaaaaaacaaaaacaaaaaaccagaaatggtacttgtgctatgatgatttaaatatgtgtatattcatttatacacaatatgactgtaaagtaataagactggttttgtgtaaccctgcttacacatttttttcagacacactgtaacctattatctattatatgttattaggttttaaatttatattatattaagagactgagtgttatcaactttcgtttgtttcattttatgtaaggcaatatacaagaatatttggacagctttttggaaatgttcataaattttgatctgttctattcatgtaactatgtatgtacatgcacatctgtatatgcactatgttatatctatattatagatcttaggtaacaacaaacatatttgtgtgagtcaaaatgtacctgtatatgtatgtatgtatgtatatttctctgttaaagcaggagagctaatttctcaataaaatggatttaaatttgt

SEQ ID NO: 411550 - DNA, 937 bp, Homo sapiens
gtggctggacaaatgccgctctcaactgctacagaccaaagtctacgctttaaagatagagaagccattctgtcaaagtgaaaacagaagcggtaggtaggaagccgcccccctttctttcaagcacagagacccagagagacgcccaggagctcccgaaaaaaacgttgctgattagagctgccgggtcagaaacagctgtgagacactaaagtccccactgttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtgggctttgctcacccagaaacagttgaggattgccacttcctagctgcgatatgcccagattgt

SEQ ID NO: 411551 - DNA, 784 bp, Homo sapiens
cacgaggttcccttcgagggccggaaggggttaatctcaggctccggcgtctggggagaaggtgaggcggttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtgggctttgctcacccagaaacagttgaggattgccacttcctagctgcgatatgcccagattgt

SEQ ID NO: 411552 - DNA, 664 bp, Homo sapiens
gtggatggtgtctcaatgatgagaatagcgacagagatggtgcagttgtgtcctctgtggaggtctggagagtggggaagagggtgaggctgcttgggcaaggatttgggaggcactcagctgtgagagacatagagggtgggaattccatcagccaaatatttatcgagtgctcactacacatcaggggctatgctgttattggactggcagggttcaggctaggctggaaaactcttcctggaactgattggtttctggtgggacagaagccagataagcctcagcattagggcattgtttgaagtaggcctcattcatctctgggctaccacaggtgtctggggtctgtcaggatcaacaggccttgagagagactgacccagaggactactaaaagggacacctgcccaggccagcctattctaccatcctcgttctcctgcaaaaccaaggccacgtcatttcagcagaggacctgcgtgtggaaggaccctgcagctggcccatcacaggagaggcccagactcacctcccaaggggaccctggcacatgaagatgctggttctcctgggagtgctgccctggcccacaggatagaagcgcaggatggtcacccatgtctgctcttattgaatgtgtcttagaagcggctccatgtgt

SEQ ID NO: 411553 - DNA, 465 bp, Homo sapiens
ttggtggtgcttgtcaaaggcttcgtagcagcggccctggcaggaggaaaggggttctgagttgcaaatcagaaacttgaagatgaaatggctactacgctgggtattgcctttatcttgaatgccagcctgatggtccaaggtgaacaagccttcctgtgttttctgaatgtgcagttcccccgcactttgcctgccaccatgtaagatgtgtctttgcgcctcctttgccttccaccatgattgtgcggcctccccagccatgtggaacggctggaaatgatggtatggagatgttgcaccacgtggtcccttcactagaggaagagtggtatgaatcgtgtccgtcactgtgacaccatgcagtcttcctggcagtacacaagttgtgagagtttgctaccatttttacatttttgtgatttaaagtgttgaataacaattaataatgtcatacatactaaa

SEQ ID NO: 411554 - DNA, 599 bp, Homo sapiens
ttggtggtgcttgtcaaaggcttcgtagcagcggccctggcaggaggaaaggggttctgagttgcaaatcagaaacttgaagatgaaatggctactacgctgggtattgcctttatcttgaatgccagcctgatggtccaaggtgaacaagccttcctgtgttttctgaatgtgcagttcccccgcactttgcctgccaccatgtaagatgtgtctttgcgcctcctttgccttccaccatgattgtgcggcctccccagccatgtggaacggtgtctggggtctgtcaggatcaacaggccttgagagagactgacccagaggactactaaaagggacacctgcccaggccagcctattctaccatcctcgttctcctgcaaaaccaaggccacgtcatttcagcagaggacctgcgtgtggaaggaccctgcagctggcccatcacaggagaggcccagactcacctcccaaggggaccctggcacatgaagatgctggttctcctgggagtgctgccctggcccacaggatagaagcgcaggatggtcacccatgtctgctcttattgaatgtgtcttagaagcggctccatgtgt

SEQ ID NO: 411555 - DNA, 487 bp, Homo sapiens
ttggtggtgcttgtcaaaggcttcgtagcagcggccctggcaggaggaaaggggttctgagttgcaaatcagaaacttgaagatgaaatggctactacgctgggtattgcctttatcttgaatgccagcctgatggtccaaggtgaacaagccttcctgtgttttctgaatgtgcagttcccccgcactttgcctgccaccatgtaagatgtgtctttgcgcctcctttgccttccaccatgattgtgcggcctccccagccatgtggaacgacacaactcttcaccagtgcacaaaacctgatgagaaggatacagactggattttggtccagcttgctgcttaactaggttcccttgcacaacgcacaacctgtgcaatgattatgcagtgaaattgatggccattacctaacgtggcttcagtgaccatgttttcaaaactgggagtcagagtgcatggcttgacatcaaggctttgtgtcaca

SEQ ID NO: 411556 - DNA, 364 bp, Homo sapiens
agcaccctggctcccacttcagacaggaagattcttacctccctcatcagactagcaggctctttgtctccccaccagtttgaggggctccccatttctatcattcatttggaagctcatcagctctcccagaaggcatgggagcccttcaacacccccatcagactaggactacccatctcccccatcaaattagaactgcattgtctcacacatcaaagtatcactcctggccaggtgcagtggctcccgcctgtaatccaagcactttgggaggccgaggcaggaggatcacctgaggtcagaaattcaagacaaacctggccaacacggtgaaacccggtctctactaaaaataacaaat

SEQ ID NO: 411557 - DNA, 3094 bp, Homo sapiens
  misc_feature (1)..(1): n is a, c, g, or t
  misc_feature (3)..(3): n is a, c, g, or t
  misc_feature (5)..(5): n is a, c, g, or t
ngntnatgggtcggtgagcgcgtttcccgcctgagcgcaactagcggcgggtcgtgggcacctccagaaaagatcccgcaccatcctccaggatccaatggccttggagagagggctgcagggcccacggacattgctgactcttcagaacgtgctgacatggagccaggtagactgaaattaccatgtgtccaaattaaaattgcatacttcaaggattatttgaaggactattcttagacccttttaagaagatttaaagaaaaaccactcggccctgagtgcggcgaggaccctgtttgtggatgtggaggagcgcgggccggaggccatggacgtgaaggagaggaagccttaccgctcgctgacccggcgccgcgacgccgagcgccgctacaccagctcgtccgcggacagcgaggagggcaaagccccgcagaaatcgtacagctccagcgagaccctgaaggcctacgaccaggacgcccgcctagcctatggcagccgcgtcaaggacattgtgccgcaggaggccgaggaattctgccgcacaggtgccaacttcaccctgcgggagctggggctggaagaagtaacgccccctcacgggaccctgtaccggacagacattggcctcccccactgcggctactccatgggggctggctctgatgccgacatggaggctgacacggtgctgtcccctgagcaccccgtgcgtctgtggggccggagcacacggtcagggcgcagctcctgcctgtccagccgggccaattccaatctcacactcaccgacaccgagcatgaaaacactgagactgatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattgccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 411558 - DNA, 900 bp, Homo sapiens
atgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 411559 - DNA, 1067 bp, Homo sapiens
ggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtga

SEQ ID NO: 411560 - DNA, 480 bp, Homo sapiens
ggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcaggtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaaaaatgtagcacaagccttatgaatttttacttttcactccatgggattcccatatcaaaagacctattctacacaaaataaagttctctatgaagaattgtc

SEQ ID NO: 411561 - DNA, 607 bp, Homo sapiens
ggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcagtagacctgactggggagctaagtgatctcgtgtgactctctatgcctcgttgccaccagcgtgggccatctccaggggctctcaaaccgatagaagaccttgcggtgtgggaaaacagctccagagcttctaagctgagcggattgttcctagtgaggatgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttg

SEQ ID NO: 411562 - DNA, 466 bp, Homo sapiens
cgtgagaacacattgcctcatacttgctgcaatagagttgaataagtaacagcttttaaattggattatcaactcacattgctaccaaatacgagcatatcaatagcaagtcatttggggtgaatggatatgttgactgccacacctgggtttctgtgactactcctggattcagtgatggagtcagccccaagtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaaaaatgtagcacaagccttatgaatttttacttttcactccatgggattcccatatcaaaagacctattctacacaaaataaagttctctatgaagaattgtc

SEQ ID NO: 411563 - DNA, 639 bp, Homo sapiens
ggtgtttgaccaaactactgggcaccataccccagccaagtcagcatataatgtgaaccatcacagtgggagacatgtcacaaagtggtaagacagcaagaattggtggtctgggctggattccagagaacctggactgtgcctatgaagcaccactgccctgtagacctgggataataaacactgatgcctaaagggaccaggcagtagacctgactggggagctaagtgatctcgtgtgactctctatgcctcgttgccaccagcgtgggccatctccaggggctctcaaaccgatagaagaccttgcggtgtgggaaaacagctccagagcttctaagctgagcggattgttcctagtgaggagtcttgtcccatctgttccaagctatttgtccatgtaaaactgtcaacgttccaagccactgactgacagggtaagaagagtgagtctcaagagagtgaggaacggtgaatctttggcagactctgtgtgtgcccatggaagagacagtgacagaaattatgtaatgaaaaaaatgtagcacaagccttatgaatttttacttttcactccatgggattcccatatcaaaagacctattctacacaaaataaagttctctatgaagaattgtc

SEQ ID NO: 411564 - DNA, 457 bp, Homo sapiens
gatgagctactcttcctcctgcactggccccaccacctgggatgagctgctcttccccttatcttcttccccctctaaagaggccaggctgggggaagagtatgtagcagagaagttgccaagtaggttcatcgagtcgtctcacacagagctggcaaaggacaatccagcaacttctctgctacatactcttcctcctgcactggcctctttagagggggaagaagataaggggaagagcagctcatcccaggtggtgggggaaaaggtgcttgaagaagctctgttgtctcgggagcatgtcttggaattggagaacagcaaggcccccagcctggcctctttagagggggaagaagataaggggaagagcagctcatccccttccttcttccctctcctcctggctggccccatggattacctgggagataaactcacagtggcccagacccac

SEQ ID NO: 411565 - DNA, 1223 bp, Homo sapiens
cctcgagagcccttatctgtctgcatcgtgctagacgttaccatgacctggacagcctccatcgccccgggggctctgacatgctcagatcccaggatggggctgcagttataggggtctcaggttggccttcccgagacaggcgtccctgtccccttgtgtccccacccttggctgtccccaggcctctcccttttcctgttttgatgctggctcagccaggcccggagacaggggcatgatgtcctaatcctccaggcgggagccaccatggagggttcccgtggactcagtcccctgccaagccacctttcccagcactcacatatgctccacctggcacatgatacacgtgggggctcctgagccccagcaccctgacttagtggggagggaccccaccggggtcccatgaagccccctgacttccactccaggcagcaggtcgggggaacaccagttgcctgccctggccgccagcacagcactcgtaaatcagggggtgtctggggcgtcggaaatggctgtgtggaatgtcggggtggggtaggctgggggtgagcccttaactcttagaagggtggggtgtggggcagaaggagcagatgcctggattcgagggtgcaggagatgggctggtgcagacgtggggcctcctggctgcaggggccggcagtgaagaggttagctcccagcccaggcagggcataaatttggggcacagctcccactctcaggacctgcccgtcacaatggccgtagggaagttcctgctgggctctctgctgctcctgtccctgcagctgggacagggctggggccccgatgcccgtggggttcccgtggccgatggagagttctcgtctgaacaggtggcaaaggctggagggacctggctgggcacccaccgcccccttgcccgcctgcgccgagccctgtctggtccatgccagctgtggagcctgaccctgtccgtggcagagctaggcctgggctacgcctcagaggagaaggtcatcttccgctactgcgccggcagctgcccccgtggtgcccgcacccagcatggcctggcgctggcccggctgcagggccagggccgagcccacggtgggccctgctgccggcccactcgctacaccgacgtggccttcctcgatgaccgccaccgctggcagcggctgccccagctctcggcggctgcctgcggctgtggtggctga

SEQ ID NO: 411566 - DNA, 1510 bp, Homo sapiens
cgcggtggcggcgggcggcgcgggggcacttgttgttcttcgcgaagtcggagcccgagcgccaggcggcggcggcggccgaggggagcgcgacagtgagcgccggcgcgaggacagcgcgtgcccgcgaggagccgccgcgcgcccgcgccctccgcgcgacgccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggctcccgtgggcccagagctgcacgccggtccacagacacactcacgcccgccacctgctccccgcaggatgtgtctgtgtgtgggaattggtatcttgcacccgtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagcgtcccccacagagagagcgtcccccacagagagagcgtcaacagcacaccccaccagagagaggtcgggatcctctagatcactgcagca

SEQ ID NO: 411567 - DNA, 1402 bp, Homo sapiens
cgcggtggcggcgggcggcgcgggggcacttgttgttcttcgcgaagtcggagcccgagcgccaggcggcggcggcggccgaggggagcgcgacagtgagcgccggcgcgaggacagcgcgtgcccgcgaggagccgccgcgcgcccgcgccctccgcgcgacgccagctacgagttccagggagctctgtcctggtgaccgtgcccgggttatgacgactaatcccaaaccgaataaggcattaaaggtcaagaaggaggcgggcgagaacgccccggtgctcagcgatgatgagctggtgtccatgtcggtgcgggagctgaaccagcacctgcggggtctcaccaaggaggaggtgacccgcctgaagcagcgtcggcgcacactcaagaaccgcggctacgcggccagctgccgcatcaagcgggtgacgcagaaggaggagctggagcggcagcgcgtggagctgcagcaggaggtggagaagctggcgcgtgagaacagcagcatgcggctggagctggacgccctgcgctccaagtacgaggcgctgcagaccttcgcgcgcaccgtggcccggggacctgtggcgccctccaaggtggccaccaccagcgtcatcaccatcgtcaagtccaccgagctctcctccacctccgtgcccttctcggctgcatcctagtgccggccgggggcggggggtggcgggcggcgggcggcgggcaggcgggtgggggcacacccctcgtacctgtcactgggatgcagactctcgacatccgagtccaagcgcaggcccctcgggcgcaggcagctcacaccaggaagagactgtattgcagggtgaagagtgggagtcgggacatataatggaaaggccctcgggaagttccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagcgtcccccacagagagagcgtcccccacagagagagcgtcaacagcacaccccaccagagagaggtcgggatcctctagatcactgcagca

SEQ ID NO: 411568 - DNA, 533 bp, Homo sapiens
ctgtctgtgtgtgttagaggattccgcgtcctctgtgggggctgccggaagacacggccccaggagtcaggcccctgtggtcaggtctagcatggggcttgttttccactcctgctgtaagcagccttcgacacctgtcctgccacggcctcccagccggtgcgggagcccctcactgccctgaccgactccgcagtccccggggaggagcatggatggtgtgtcggcagctccgtccttccagctgtcccgttgcagtgcccgtgatccgcgtctgccttagcaggggcctgcgtgagtgggcacggtgtgggaggtcgcctgcgtggggtggtgtctgtgtgtgtgcacgcacgcctgccatcaaagcagcagggctgagggggtgcagcttgctggtgttcactgggggagggcctgtgggcacacatggcagagagagcgtcccccacagagagagcgtcccccacagagagagcgtcaacagcacaccccaccagagagaggtcgggatcctctagatcactgcagca

SEQ ID NO: 411569 - DNA, 609 bp, Homo sapiens
atggctactctgatctatgttgataaggaaaacgaagaaccaggcatccttgtggctacaaaggatgggctgaagctggggtctggaccttcaatcaaagccttagatgggagatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctgtgacatagatatttaa

SEQ ID NO: 411570 - DNA, 189 bp, Homo sapiens
aggcaataggtttattagatcataagtaacgtgaatttcacttttatggtcagacttactgcgaggaattgcagatggagtttgtaggttaggatcagcactggcaaaattaatttgaccgtgttattgcctcatgagactcccagtcctgcagttaagattgacatcagcaaaagtataaggtcggtg

SEQ ID NO: 411571 - DNA, 236 bp, Homo sapiens
tcagagaaatccagggatgaggtctaagaggaatgacctgctcttctcttaacattctcaagtgggtcagagttagggtggctagaggtttttgtttgcctgggacagcgcctgcatacccctgttgtccctgagtaattattaacagcacctccctttttgctcctaaaattatcctagtttgaatgataaattatagaaatacctcaatcatccgttctatgggaatactggac

SEQ ID NO: 411572 - DNA, 253 bp, Homo sapiens
gggagctagaagtagatggtacctacataaccagccctctgtaaaatccttgggtactgagcctcagagttctcctggaagtaacacagatcataacttgttgctggagggattaagcacatcctgtgtgactccactgggagaagactctccaaagcctgtatctggacttcatcatcccctgtcccttttccctttgtcgattttgttttgtatctgaatcttcagtacaataaatcttagctgtgaatac

SEQ ID NO: 411573 - DNA, 3166 bp, Homo sapiens
  misc_feature (1)..(1): n is a, c, g, or t
  misc_feature (3)..(3): n is a, c, g, or t
  misc_feature (1410)..(1410): n is a, c, g, or t
  misc_feature (1859)..(1859): n is a, c, g, or t
  misc_feature (2205)..(2205): n is a, c, g, or t
  misc_feature (2547)..(2547): n is a, c, g, or t
ngntctggacagtgtttctcgatcagaaattgccttgggttgcaaagacctcaatcatgtcagcttatcttctttgataccagaactagatgtcacctccgaatatattaattcagacactcttgtcagagagataaacaagcatacatctccagaagaatataatctaaatttatttctgcaagaaaaaaaacacataaacctgactaaactcggcttaaatgtacaaaaacatcctggaaatgagaaagaagattcactacaatatttggccaataagaaatatacacaaggccggggaagccacagccaagaaatgaggtacaatcgacaaaacagatggaaacggcagaactttcatgagtttcctcctttgtttgctttcccgagtctcagccaaacggatctggaagaacttacttattttttcccagaggaccatgctgaggatgtacagcaagagtttttcccctcttggcccactccctctggcctcaccgagtatagcaccttgaccctctgtcaggagactctagccaactccagcataggaaggctgtgtcttgcttttcttggcaagagattagacagtgttatagagatgtgtgtgaaggatgttctgttaaaagatgatcttagttgggcagaagcaggtgtggcccttttagaaaatgaatgtgaaaagaggattgtggaggaggggaaatataacacagaagagtatggcacatcaattgaagacattctctcagtattaaaatgccccaatttatgcagcggcaatgggcagtgcatggaatgggggtgtgcgtgttccccaagctttagttcctatgactgcagtgattcctatgacaaagctcctgaaattacagagcttgggaatgctggattctgtgatgttcaaaaatataattgtatgatggtgagagtttttggcaaaggcttcaaagaattaccttcaattaaatgtgaagttactaagctacagtataatagcagtgaatggatgcctggagaacccatctatacacagactgttttccacaatagcagagctgttgattgtcagctgcccactgatgttcagcagtttgataccatggatctggtgggtgggaaaccaactgggaagtggcagttgaaggtatctaatgatggttataaattcagtaatcccaaaataacggtcatatatgatggtgcttgccaagtttgtggtctctataaaaatgactcatgtactataaaggaaaatgtttgcattattgatggactctgctatgttgaaggagacaaaaatccaaccagcccttgtttgatttgtagacccaaaatttcaagatttacttggtcatttttagaaaacaaccagcccccagtgattcaagcattgcaagacaaattacngacattttatggtgaaaactttgagtatcagttcgtggccttcgatccagaaggttctgacatccattttacgttggactctggtcctgaaggggcaagtgtttcctctgcagggctttttatgtggaaaacagatttactaactacccaacaaattactgtacgccttaatgatgactgcgatgctgaaactagagtcacgattgaggtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaagttgaaacacagtttgtaaatnaatttactacacaaactgtggttctcacaagatctgataaaagtgtaaataaagaagaggatgataaaaatgcccaagggagaaagaggcatgttaagccaacaagtggaaatgccttcaccatttgtaaatatccatgtggaaaaagtagggagtgtgttgccccaaacatctgcaaatgtaaacctggttacattggttctaactgccaaactgctctttgtgaccctgattgcaaaaaccatggaaaatgtattaagcctaacatttgtcagtgtcttccaggacatggtggagcaacctgtgatgaagaacattgtaacccaccttgtcaacatggtggcanatgcttggctgggaatctctgcacttgtccttatggttttgtaggaccaaggtgtgaaacaatggtttgtaacaggcactgtgaaaatggaggccagtgtcttacaccagatatttgccagtgcaaacctggctggtatggacccacctgtagtacagctttgtgcgaccctgtctgcctcaatggtggttcgtgtaataagccaaatacttgcctctgtccaaatggattctttggggaacactgtcagaatgctttctgtcaccctccctgtaagaatggtggccactgcatgagaaataatgtgtgcgtctgtcgtgaaggatacactggtaggagatnccaaaaaagcatctgtgatcctacgtgcatgaatggaggaaaatgtgtgggaccaagcacttgctcttgtccttctggttggagtgggaaacgatgcaacacacctatctgcttgcagaaatgtaaaaacggtggtgaatgcattgcgcccagcatatgccattgtccttcctcctgggaaggagtgcggtgtcaaataccaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaatatttaataaactgaatattttctcagccctaact

SEQ ID NO: 411574 - DNA, 577 bp, Homo sapiens
agagtacatagattagatccattcattgatggttcattaatagattcttatgactgcattggtgtccaatcaccagatagccccagaccactaggatagaatatgccacaagcatttcatgtcaaaggatggtcattgtaaaaatttgtgtattgcagcaatttgcaacccaaaatgtctttatggaggcagatgcatatttcccaatgtgtgttcctgccgcactgaatactctggagtcaaatgtgagaagaaaatacagataagacgccattgagtagcatcaagtatatgaattacaagcctgtatcttaagaatggaaatattttgttcagaaaaagttggagataacttggagtttatttgaacatcattcaaaaaatatcttaaagactgaagaaactaataaaatacataatgatctctgttgtaatcatagagaaaagcaaagaagaaatccaggtaatctaaatttgatgttgagatgggataggatatttacatattgagatgatgtatctgatattccacccattcacaatatttaataaactgaatattttctcagccctaact

SEQ ID NO: 411575 - DNA, 255 bp, Homo sapiens
cgacgcattcaaacaatggaacattttgcaactgttaaggtcacattttccaagaatatgtagtgacattcaaaaatgttcttgataaaatattagggaaaaatttctttaatcacttacttgtaactatttctttttttctctctaatgaaaagttttgtgggttatggataggatttgactagtaatttaaaattttaacttgtttatatttcgattggcagctatctgcttgcagaaatgtaaaaacggtgg

SEQ ID NO: 411576 - DNA, 422 bp, Homo sapiens
gtgactgtgaagtcttgtgattgcttgaatggtggatcatgtgtatctgataggaacttttctccagggagtggagtgtacctgtgtgtctgcttgcctggcttccatggcagcctttgtgaagtggacattagtgggtgccaatccaacccttgtggtcttggcagctatattagtggttttcacagttattcctgtgattgtccacctgagctcaaaggtaagattttgctcctcataacaaattagaaagaaaagctccttgaaacacatatctacagattacttaagcaaatgtgtggtcctaaagattttagtacacatctttacaattttaataaaagttattacaaatataattactatccatatcccttgtttttgtaaattgcaagttccatgcactattacatttttgccaa

SEQ ID NO: 411577 - DNA, 476 bp, Homo sapiens
ttttgagacagattctcattctattgcccaggctggagtgcagtggcagtcccggagccctgaactcctgggatcaaatgatccacctcaacctctcaaagtgttgagattacaggcgtagccaccatgcccagcctctttctcttagtgttgactgtgttaacgttgagccccatgcttgtttaatgaggctcataagatgaatagtgttcagtcatttcctggcgtgtcattgttactagttatttacatctgcacgtcaacagtgtgtcaaggcacagtatgagtttctgtcgactaaattgtagggagaacttgaggaccttcaagaagattgaactttattgtgaacaggtagagtacctgttgttgcagagttattttctgagtcagtttcaggtaaggctaagagttttataaatgtgcttctttatatcatggtgtttcttaccaagggaaagatcaaatctttgagc

SEQ ID NO: 411578 - DNA, 3173 bp, Homo sapiens
atggaggcgggaggagagcgatttcttagacaaaggcaagtcttgcttctctttgtttttctgggagggtctctggctgggtccgagtcaagacgctattctgtggctgaggaaaaagagaagggctttttaatagccaacctagcaaaggatctgggactaagggtagaggaactggccgcgaggggggcccaagttgtgtccaaagggaacaaacagcattttcagctcagtcatcagacaggtgatttgctcctgaatgagaaattggaccgggaggagctatgcggccccacagaaccatgcatactacattttcagatattactgcaaaaccctttgcaattcgttacaaacgagctccgtatcatagatgtaaatgaccattctccggtattctttgaaaatgaaatgcatctgaaaatcctagaaagcactctgccaggaacagtaattcctttgggaaatgctgaggacttggatgtgggaagaaacagcctccaaaactacactatcactccgaattcccacttccacgtactcactcgcagtcgtagggacggaaggaagtacccggaactagtactggataaagcgctcgatcgggaggagcagccggaactcagcttaacgctcaccgcgctggacggcggctctccccctcggtctgggacagcccagataaacatccaggtcttagatataaacgacaatgcaccagaatttgcacagccgctctatgaggttgcagttctagagaatacccccgttaactctgtcattgtcactgtctcggcttctgacttagatacaggaagttttgggacaatatcatatgcattttttcatgcttctgaagaaattcgcaaaacttttcagctaaatccaattactggtgatatgcaactggtcaaatatttgaattttgaagcgattaatagttatgaagtcgacatcgaggccaaggatggcggaggcctatccggaaagtctacagtcatagtccaggtggttgatgtcaacgacaacccaccggaactgaccttgtcttcagtaaacagccctattcctgagaactcgggagagactgtactggctgttttcagtgtttctgatctagactctggagacaacggaagagtgatgtgttccattgagaacaatctccccttcttcctgaaaccatctgtagagaatttttacaccctagtgtcagaaggcgcgctggacagagagaccagatccgagtacaacattaccatcactatcactgacctggggacacccaggctgaaaaccaagtacaacataaccgtgctggtctccgacgtcaatgacaacgcccccgccttcacccaaatctcctacaccctgttcgtccgcgagaacaacagccccgccctgcacatcggcagtgtcagcgccacagacagagactcaggcaccaacgcccaggtaacctactcgctgctgccgccccaggacccgcacctgcccctctcttccctggtctccatcaacgcggacaacggccacctgtttgccctcaggtcgctggactacgaggccctgcaggcgttcgagttccgcgtgggcgccacagaccgtggctccccggctttgagcagcgaggcgctggtgcgcgtgctggtgctggacgccaacgacaactcgcccttcgtgctgtacccgctgcagaacggctccgcgccctgcaccgagctggtgccccgggcggctgagccgggctacctggtgaccaaggtggtggcggtggacggcgactcgggccagaacgcctggctgtcgtaccagctgctcaaggccacggagcccgggctgttcggcgtgtgggcgcacaatggcgaagtgcgcaccgccaggctgctgagcgagcgcgacgcggccaagcacaggctggtggtgctggtcaaggacaatggcgagcctccgcgctcggccaccgccacgctgcatgtgctcctggtggacggcttctcccagccctacctgcctctcccggaggcggcaccggcccaggcccaggccgacttgctcaccgtctacctggtggtggcattggcctcggtgtcttcgctcttcctcttttcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcagttaagtgttaataaggatctactgagcctcgtcttagttaatctgtggaaagtccttttttactgctttgtccattggagaggtcttttttggtctggttcaaggcaagtagcaagaatagagcaaaatatcaaatccagggatggcttaggtttcattaacagtactggaaagtagttgtgtggctctgaatgttttgtatttcaatcgagaatccttagtcgatagaacattttgtttatatattgattctactttttctgtagttaatccttgcatattctcctttcatcctggcttgccaacgcagtcttaattccgccttttttttttctaatggggagcaaaaagaaattcactgtcttttaatagtgatttcaaatagcttattaaaataactccattcaaattttacattataaagcaatgtagagagagttccaaaccaccaattttataatttcccttgttgaatatattcatataatgtgttctataatatgcccaaagcagctttgtctatagttaacaaagttttaaggatagacaagaatgtgttttctttaataaatagtaatatatcatctttttagggatatagtactcaaatgaaagtaatttagttcattttctgtgttgacatttgcaattaatatttcaatattttatgtgcttatattggccaaaatatggacacaaatatagactaatatgggtaattaccctttggtttatctaaagtgtgttcatgatgactgaggaaaaaaattaaacctatgccattta

SEQ ID NO: 411579 - DNA, 1687 bp, Homo sapiens
ctgtgcgctgctgagctgagctggggcgcggccgcctgtctgcaccggcagcaccatgtcgctcatggtcatcagcatggcgtgtgttgggttcttcttgctgcagggggcctggacacatgagggtggtcaggacaagcccttgctgtctgcctggcccagcgctgtggtgcctcgaggaggacatgtgactcttctgtgtcgctctcgtcttgggtttaccatcttcagtctgtacaaagaagatggggtgcctgtccctgagctctacaacaaaatattctggaagagcatcctcatgggccctgtgacccctgcacacgcagggacctacagatgtcggggttcacacccacgctcccccattgagtggtcagcacccagcaaccccctggtgatcgtggtcacaggtctatttgggaaaccttcactctcagcccagccgggccccacggttcgcacaggagagaacgtgaccttgtcctgcagctccaggagctcatttgacatgtaccatctatccagggaggggagggcccatgaacctaggctccctgcagtgcccagcgtcaatggaacattccaggctgactttcctctgggccctgccacccacggagggacctacacatgcttcggctctctccatgactcaccctatgagtggtcagacccgagtgacccactgcttgtttctgtcacaggaaactcttcaagtagttcatcttcacccactgaaccaagctccaaaactggtatccgcagacacctgcacattctgattgggacctcagtggctatcatcctcttcatcatcctcttcttctttctccttcattgctgctgctccaacaaaaagaatgctgctgtaatggaccaagagcctgccggggacagaacagtgaacagggaggactctgatgatcaagaccctcaggaggtgacatatgcacagttggatcactgcgttttcacacagacaaaaatcacttccccttctcagaggcccaagacacctccaacagataccaccatgtacatggaacttccaaatgctaagccaagatcattgtctcctgcccataagcaccacagtcaggccttgaggggatcttctagggagacaacagccctgtctcaaaaccgggttgctagctcccatgtaccagcagctggaatctgaaggcatcagtcttcatcttaggggatcgctcttcctcacaccacaaatctgaacatgcctctctcttgcttacaaatgtctaaggtccccactgcctgctggagagaagacacactcctttgcttagcccacaattctctatttcacttgacccctgcccacctctccaactgaactggcttacttcctagtctacttgaggctgcaatcacactgaggaactcacaattccagacatacaagaggctccctcttaacatggcactgagacacgtgctgttccaccttccctcatgctgtttcacctttcctcagactattttccagccttctgtcagtcagcagtgaaacttataaaattttttgtgatttcaatgtagctgtctccttttcaaataaacatgtctgccctcattgctttaggtaatgtgacactattcgctgaaagaaaccgctgttatcattaccatgtccacataaccccatctgttatccactgggttc

SEQ ID NO: 411580 - DNA, 411 bp, Homo sapiens
tttttcttaggttggcatcaactaccagtcccccacagtggtgcccgggggtgctgtagccaaggtgcagcgggcagtctgcgtgctaaacaataccacagccatcactgaggcctgggcccgcctcaaccaaaagtttgacctgatgtatgccaagcgggcatttatgcactgttatgtggacaggggcatggaggaaggtgagctctctgggcctgagaggacctggctgccctggagaaggattatgaagtaggcacagaatctttggacagcgaggatgagcatgaggagttctaggggtcctggcacctgtaacacctggtctctcgcaccacagttgtgtgtgtatctcattccactgttccctgaccccctacaaatacaatggatattgcaagcgatgtggaa

SEQ ID NO: 411581 - DNA, 236 bp, Homo sapiens
ccaatattttgtgtatctttatacaattgaatattttactaaattttctttaaatcggctgttagcatctcttaattttcttttaaattgagttgttttttaaaggcatataggcataccacttaaaaagtcaaagcgtctacctgattatgaagagctttctgtcctttcttcttccatcttgtagcaccacccagaagaaattgcttttaataattttctaatctttcatcagg

SEQ ID NO: 411582 - DNA, 340 bp, Homo sapiens
gtaaaatggaacccaactcaattacctatattgtgcaagatatatcaagtgcattgccaattacctttacattagaaaactaaaccaagccaggaaaaaaaaaaaggattactacttaagggatttataacaaattattgggcatacacaatacttagtataattctccaacaaaggcttctattgaaccctacctgggtaaaggaaaccacaaccatttaaataatacaagaaaaccaaacccgagttacactggcaaaagtgaaaacaaagtgggtggctacaggactttgtaaacactctccttcctctcctctcctctgggaaaataaaaaccaaa

SEQ ID NO: 411583 - DNA, 441 bp, Homo sapiens
tttcctttcaaatcacacagggaacacccattcctttatcttttcgttttatagaactatatatactctttaatattctaccattcgaccagtttttgaaacctagagaacacaatcttaattttagtaactataaaaacaacaaaatatgtcatttcctaatcaatttatgtcaattaaacacaattttaaaaatatgaatgagctctactcaatgaattcaaactattaattcccatggagaacaataaactttggtcatagttttgggaacaagtttttgcacatatttgatattgtgttcatgaagcccaaataaccatgattggaaataaattatcattttttcctacagttttcagaacctagatgatattacaaaagcatctcatctttctgccattgcactctagcctgggtgacaagagcaagactctatct

SEQ ID NO: 411584 - DNA, 394 bp, Homo sapiens
tcccacaggtacctcagaaatcgcatgtccaaaattgaacttaacattcttctctcaaaatatttttcttctttgattttctgtatcttgatagtgtcactgcctacctttttacctgtgctagaaacatgaaaatcattcttgattatttcaatctttttattttttttccacattcagttcattagattctctttctccttgctttcactcccctgattcaagtccaagtcatctcttacctatattactgcagtagtttcctaactgatttctctagttctaacctggtctctcctcaaatccattcttcacagagtggcaaaagtgattaaaattctttcattaaaaacttggaaaaatgattgcaatgatataaatggtgcttacaaat

SEQ ID NO: 411585 - DNA, 114 bp, Homo sapiens
tgctatccccatggattagtttttccttatgccaactttcagataaatggaatctcatcatgcatattcttttttatctcacttttcctcaacattaaatttgtgttgcataaa

SEQ ID NO: 411586 - DNA, 740 bp, Homo sapiens
tttgaaaagatctgaagatacgccccttggatgcctgcagagaagctctggggcttcagtcaatgactcagggtagccaccgaacatgatgctcgggcagtgggtgccacctggactccactctcccctctctctgggatcatagagtccaaggtgttctgtggcctctcggccaatcccagcagctcagcgtgcagaagaccgaggagccattggaattcaacacaacacgaaataatcaacaaattcggggaatgttaatctgaccatcaccagttacaaatgatgtttcatgctaccttctattcctgccttcataaatcaagctctaaatctccaggaaaaaatgtgctcaggatggccagagaaatgtccttccaactgtgcatggaaaggtatgattttgtgcagcaggtgaaggactggttagagtaagtgtgtgctgagcttttgtgtttgaaagcgagcctgtgcacttctaacgattggaaggtttccttgccttctccgatcttacacacagcaaggacagcaaagccttccagacctgcctgtgacatgcactgcacattctaaagatgcctatgcaatggaaaacaccactgtctgctccagcacagctgccattcttccatcttatcgaccttaatgcaacaactcctcacaggcagagattttaaaatgtgttcttggcagaagagagactcaaagatgggacaaatgtgtcatttaaatgcctg

SEQ ID NO: 411587 - DNA, 1111 bp, Homo sapiens
tttgaaaagatctgaagatacgccccttggatgcctgcagagaagctctggggcttcagtcaatgactcagggtagccaccgaacatgatgctcgggcagtgggtgccacctggactccactctcccctctctctgggatcatagagtccaaggtgttctgtggcctctcggccaatcccagcagctcagcgtgcagaagaccgaggagccattggaattcaacacaacacgaaataatcaacaaattcggggaatgttaatctgaccatcaccagttacaaatgatgtttcatgctaccttctattcctgccttcataaatcaaggaaaagaaaaagagaacatatatccccctaccttttgatttccaacagtctactgagaggccaagattatttgcagggaaagaaaaggggaatgccatccccaccctctcgcagctacgtgccagttccagagcacctgttcccctctactttgaaaaggtcaaaatgttttgccagtaactcccaaatcatctacagccaaggagaaaagtgtttcaagacagaggtgctcaatggtatcaaatactgccaacagaccaagtaatacatgcattgaagtgtctactggatctagctatatgaatttttaatttaggacacttaggccatactgaagcaaggtgacaaaatgaatagctacaatgtctcgtgaatcttgggtttccattcaccctggtattcaagagaaattcttgcatcatggaagttgcagttggataggactttctcagctgaacactgtcatctgccagagcttcaggcaagaacccagaacagatgaaaccccagacatgacaaaataagccaaagaataccaggccaaggtgtgaaaggccagatgagaacaagcagcgtacacgattctgttgccaacagatctcccctaacagtgtcgtgcaccaaatttccacagtgaatgtcaggaaaaaatggcaattgaggtgggtggtcaaaagagaagcacagtctatgatgaagtcaccccagagaagtcctttttccgttttctcctgagaaattaccagaagaaattaaaatccttttgagtattgcaaaaaaaaaaa

SEQ ID NO: 411588 - DNA, 486 bp, Homo sapiens
ataaaacccaaaaccctcctctaggagcttacattttaggggaagagctgaggcacacaaaacttgttaggcaacaacattccctataccaaggaacacgatttagggtgacagaacatgtgtgtagcagtataactacagtgttgtggagtaattttcatattgttgtgtaacttgggaatagatgtacatggcagctcctattttccctggaactctgatcaccaaacaaggtattcaaccttgtgatctgaaccggagaaccttccaggttaaaggctaaaaatgcctttgcagactttctctcctctgctgccctctcattactgtagcctgactttttaagaaaccaactttgttgaagaataatttatagacaataaaagatacccatttgaaatacacatttctaatagttttgacaaatttgcacactgtggtagccaccaccagaaataaaatatagaacattcctacacccttaaa

SEQ ID NO: 411589 - DNA, 265 bp, Homo sapiens
atgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctatta

SEQ ID NO: 411590 - DNA, 404 bp, Homo sapiens
ttgagcatcatgtgggtgctcaaaaagcttcagattttggagcatttggatttcggattttcccagatctgggatgtgctacctggactaacatttggatcccagcagtggacccttccatggcccctgccttggcagaaatggggaaggcagctccctgggcctccctagcacttaggcccagaagagtcctccctgcactcctcttcctgccaggtctctggaactcagtgaggcagggtgcaggagacttgagattggccagccccacgagcccagggcagtggtggaccccaggcttgtgctgctgtagtgctcttgccagccctggggggctggggcccacccagaggggtcctggttggagacctccacagagtactcagaacacgcagggctcccta

SEQ ID NO: 411591 - DNA, 346 bp, Homo sapiens
accatttcatctaacatggcagaatacacattattctcaagttcacatggaatattcaccaagataggccacattctgggccagaattatctatcttaataagatagaataagaataaagaataaagtaaacccaagataaagagaggaaaagaaataaagattagatttgaaataaagattagatttacatttactaccaaaacgtcctttggtaggtgaatggataaataaactatggaatatctagacagtgggatattattcagtgctaaaaataaatgggctatcaagccatgaaaaaacagaggaaatgtaaatgcatattattaagtgaaagaagccag

SEQ ID NO: 411592 - DNA, 399 bp, Homo sapiens
caaacatatgaaaaaaagctcagcatcattgataattagaaaaaaagaatttcaaccagcaaaaaggggtaaggagaccagacaaagcaccagcacaggcaaataatcaattttggagtaagatggagtagcatgagttacagacagcttcggatgttgtaccagattattcaggcattattatgtagaattgtacctctgagaaattgaataagggatcattactttttaaaaaaaaatgatttcaagtcataattgctaagaactacagtcacaattgcataaaaatatatagactataaatagctatacacatataatatagagatttcgtatatatagtacacataagttttttaaaagattgcagtgagttaaaaatggttaacactgattgaa

SEQ ID NO: 411593 - DNA, 822 bp, Homo sapiens
tttcatccatgtcaaccatgaaagacagagttgatctcagcctgagctagagatggatccccatccatgtacctttgctcaactgtcctcagaccagatccagaattcaccctgctgtttctccatgagtctgacctgcatcaactgcctcccttattctgggattccagttgtggagctcaaggacaagtccattctgggctggctgtatccaacttctttagtccaactatatccccactggaagccaggctctttccaacagctgtcacccatgcctctttctatgtttgttatctgtctctaggttctggtaactacttccttcccttgccccttctggcctagggtgctaccaatccctcctccaaatccaactgtcactagcctcaaagtacttgtagcttcctcaccttactttcaccttaataaatggtccccctactatctctcttcaaagcacccaatttgagtgtgccatctgtttcttgccaggatcctggttggtacatcaaccaagctgcactgatggaggagcactgtgctgaactttaggaatgaagccacagggccctcactgcccccatagtcaccttggtcatcttctgcctccctgaaagactaaattcagtcagttcagatacatacacatccagacatgtcagggaaaactccattttgtaaggatctctgcttaaaatgccaaaagtttgaaagttggcaaacacttgagaaaagcacagttctctgtcttactcttactctaaacttggagataaatgcatttttaaaattgtgcatgttagagtgctaacgtgtaca

SEQ ID NO: 411594 - DNA, 532 bp, Homo sapiens
cacttttcttgcagattgttttttgctctcgctctcaagcttctcagccttgcttactgcttcaaagacatgagtttgtaaggacagtagcagcccaaagactggcatctgtagacacatctggatcttccgtttgatctcagtgttctagtaacggaccctcggtaatcccttcctggtcatcacagcacgatgctgcttcccccctagagagtgtgaggggggcttcggcttcactcttgacagcgcttgctttgtatttcctgggttgctcttctgtcccacattggctcattgccatctgtcccttgtccatgcttccttacaaagtggacctttttcctccgcctcttccctgttcagatgctcctcgacttaaaatggggttacatcccaataaacccatcgtaagttgaaaaatagcgtgtcaaaactgcatctcatacacctaacctagcaaacgtcatggtctcgctgaccttgaacacactcagaacacatacattagcctacggctgggcaaaaaaaaaaa

SEQ ID NO: 411595 - DNA, 2635 bp, Homo sapiens
  misc_feature (984)..(985): n is a, c, g, or t
  misc_feature (1075)..(1075): n is a, c, g, or t
  misc_feature (1595)..(1595): n is a, c, g, or t
ttcacaaaaaaagaaattccaaagcagaagtcctggtatgttactattccagacaaatctgatatgagaaagcactaaagataattgaaacattaatttaataattaattaattaaaatagtacagtcctggatgtcttttttgtgctttctttaatttctttccagctatatataaatgtgtcttggtatgaatttaagtgcctgggaatgaatagtactgtcccccaggataataagttattagcaaattaataccttgcttctgttagttgtcaacatgttgcaagtaaacattgttgataggcactgtggatctactaagggtaagatatcatcctttcacaaaaggatagctattaaacctgactgtaggtaaagttaaattgcaactaaacatatgtagacatatactaagattttaaacattacacaatatttctgaccaataaaatataaactagagtctaaactgtttggttaagaatttcattgctagagtacccttacaagttctaactgaatttccaaaaatctaacattttgttctcaataaaataaaatgtgtttaataaatatgaagcaaaaaacaaaatcctaaacaaaagcaaacactgttgatcagtcaatttaacatggaatattattgctattatttttattgaccaatagtttatttcctgacttttcttctcagatatggacactattgatgggagcggctggccatctggagtggcagttgccatcatgccagtagcgcttgggccgcatgggcagtgttgtcaggagcagcagcaggagcagcagtggcggtggtaggaccccgttccctgtgtccccaaggcatctgactgcgccgccgccccctaatggctgggcaggacccactgccaggtgcagaccctccatggcggcctcaatttcgcttcctaccacatctgggagcccatcagcgctggcagccgggtcttgcaggattggnnccaggagcatcaggttcatttgtgcggcattagccagggcccccatgccacctgcacctcgcccatgcactactgcagggaaaacgcagngaggagtcacggccaaggctgcacactctatggagccagtggcagctggggacaagtgggagcccagccccttccaagttgccagggcaggaactccccaggcgcaactgcagctgcccaaggagggtctgcgacccaggcactcctgtgctcttgggagccaggagaaggcaggagccccaccctcccaggcacagctggagcctttcaagccacagctgcagacccaggcacctctgcactcttggggcctgggaaggcccccgtgaccacacaggctcggaagtgcctgcccccactgtctgggttctcctcgctgtcagcacctgctccaatcttcgagcaaagttgaggtcgagcacactatattgtgaccaatataaaatagatataaaaatacctcttacacttaaaaaaggcattgccatttgaatgacttaagaatatgcagctaaggtgcttttaaaaatacaagctagtgattatactgaatttgtaaatcacgtaggatagtgagtcnttttagaatattaattatttcagtccataaacctggatgtctttccttttttgtgttttctttaatttctttcattgatgtttgtaatttttgttatagaaatcatttacttcctcggttaagtttatttctaagtacatttttgtagctattgtaaaagaaatagcttccttaattttttttctgctagtttactatcaacatatagaaatgctactgttttttgtatgttgattttatatcctgcagctttattaaattcatttatcactctaagaagttttaggtagagaccttagtttcttccgtgtatgagatcacattgtctgcaaacaaggataatttgactgtctcctttccaattcagatgccctttatttctttctctaacctaattgccctggctaagactttcactatgtgaaatatgattggtgaaagtgggcctccttttcttgctccagttttcatggtaacatttttcaccttttccacgttcagtatgatcttagctgtagggttgtctttacgcccttttgtgttgaggcatatgttttccacactaaattgtttagaggcttttgtcatgtaagaacgtttaattttgccaaatgctttcattgtgtttattgatttaatcatatggttttcaatatatgtccaaaggaaagaaaatcaatatatcaaagccttacctgcacccccatgtttattacagcactattcacaatagccaagatatggaatcaacataagtgtccatcaacagatgaatggataaagaaaatgtgacatacatatataatggaatactattaagttataataaagaacaaaatcctgtcatttgtggcaacatgaatgcaactggagggcattatcttaggtgaaataagcctggcatagaaaaataaacaccacaggccaggcacggtggctcacgcctgtaatcccagcactttgggaggccgagacaggcggatcacgaggccaggagatcgacaccatcctggctaacacggtgaaaccccgtctctact

SEQ ID NO: 411596 - DNA, 1600 bp, Homo sapiens
  misc_feature (560)..(560): n is a, c, g, or t
ttctccgtgggatccacaggatagtccgaggatcctaggagagggcagatgtgagcgagcctgaagaaacgtcaggcagagccccaggagtaaaccgcgaaatccctagggatccaaaaggatctgaaggatgcctcaggcctgtctagtcgttgtagggatatggacactattgatgggagcggctggccatctggagtggcagttgccatcatgccagtagcgcttgggccgcatgggcagtgttgtcaggaacagctgcagacccaggcacctctgcactcttggggcctgggaaggcccccgtgaccacacaggctcggaagtgcctgcccccactgtctgggttctcctcgctgtcagcacctgctccaatcttcgagcaaagttgaggtcgagcacactatattgtgaccaatataaaatagatataaaaatacctcttacacttaaaaaaggcattgccatttgaatgacttaagaatatgcagctaaggtgcttttaaaaatacaagctagtgattatactgaatttgtaaatcacgtaggatagtgagtcnttttagaatattaattatttcagtccataaacctggatgtctttccttttttgtgttttctttaatttctttcattgatgtttgtaatttttgttatagaaatcatttacttcctcggttaagtttatttctaagtacatttttgtagctattgtaaaagaaatagcttccttaattttttttctgctagtttactatcaacatatagaaatgctactgttttttgtatgttgattttatatcctgcagctttattaaattcatttatcactctaagaagttttaggtagagaccttagtttcttccgtgtatgagatcacattgtctgcaaacaaggataatttgactgtctcctttccaattcagatgccctttatttctttctctaacctaattgccctggctaagactttcactatgtgaaatatgattggtgaaagtgggcctccttttcttgctccagttttcatggtaacatttttcaccttttccacgttcagtatgatcttagctgtagggttgtctttacgcccttttgtgttgaggcatatgttttccacactaaattgtttagaggcttttgtcatgtaagaacgtttaattttgccaaatgctttcattgtgtttattgatttaatcatatggttttcaatatatgtccaaaggaaagaaaatcaatatatcaaagccttacctgcacccccatgtttattacagcactattcacaatagccaagatatggaatcaacataagtgtccatcaacagatgaatggataaagaaaatgtgacatacatatataatggaatactattaagttataataaagaacaaaatcctgtcatttgtggcaacatgaatgcaactggagggcattatcttaggtgaaataagcctggcatagaaaaataaacaccacaggccaggcacggtggctcacgcctgtaatcccagcactttgggaggccgagacaggcggatcacgaggccaggagatcgacaccatcctggctaacacggtgaaaccccgtctctact

SEQ ID NO: 411597 - DNA, 864 bp, Homo sapiens
  misc_feature (799)..(799): n is a, c, g, or t
  misc_feature (823)..(823): n is a, c, g, or t
ttcacaaaaaaagaaattccaaagcagaagtcctggtatgttactattccagacaaatctgatatgagaaagcactaaagataattgaaacattaatttaataattaattaattaaaatagtacagtcctggatgtcttttttgtgctttctttaatttctttccagctatatataaatgtgtcttggtatgaatttaagtgcctgggaatgaatagtactgtcccccaggataataagttattagcaaattaataccttgcttctgttagttgtcaacatgttgcaagtaaacattgttgataggcactgtggatctactaagggtaagatatcatcctttcacaaaaggatagctattaaacctgactgtaggtaaagttaaattgcaactaaacatatgtagacatatactaagattttaaacattacacaatatttctgaccaataaaatataaactagagtctaaactgtttggttaagaatttcattgctagagtacccttacaagttctaactgaatttccaaaaatctaacattttgttctcaataaaataaaatgtgtttaataaatatgaagcaaaaaacaaaatcctaaacaaaagcaaacactgttgatcagtcaatttaacatggaatattattgctattatttttattgaccaatagtttatttcctgacttttcttctcagatatggacactattgatgggagcggctggccatctggagtggcagttgccatcatgccagtagcgcttgggccgcatgggcagtgttgtcaggacacacagancacatggcgtggagacccgtcctngcccaggacgctggcgcccctatgtggagacagcagtgaac

SEQ ID NO: 411598 - DNA, 313 bp, Homo sapiens
tgtgactgtcctgaatactgcaggcagctgaacacaatggcaagtacttgtgtatctagccatagaaaaggtaaggtaaaaatacaatataaaagcttcgttataggccagcacagtggctcatacgtgtaatcccagcactttgggaggccgaggcaggtctcaaactcctgggctcaagcaattcacccacctcagcctcacaacgtgctgggattacagacttgagccaccacacctggccccagaaatgttctatttcaactttgtttttgagatagcctgggcaacaagagagagactccgatttaaa

SEQ ID NO: 411599 - DNA, 277 bp, Homo sapiens
gcccagcctcagcctcacagtggactctccacgcccagctagctctcgcctcactgcggcctccccagtccaaagctcctgcctttcggccgctttggcagtcccagctcctgcctgccagtggcctctttaggcccagctcattcctcacaacggcctttccaggccccgtttttcttggcctctaatttgtttatcttttgtgtataaatctcaaaatatggaattttggaatatttctaccattatataaatatttttaaaggtaatgtatttg

SEQ ID NO: 411600 - DNA, 394 bp, Homo sapiens
gtacagacaggttctcaccatgttgcccaggctggtctgtaactactggcctcaagctatcttcctgcctcagcctcccaaagtgttgggtttacagaaatattcacaatctaatgaagaaatattcattgaggaagagctctatggcctgggaggtatcagtcttctccaagacatcaattttacttgcttacagaacataaaaaagaaattttatgtgataaatgcattaatctacagctacttatgattaggctgttctggctaaaatggaatacattatctgtaagacatctttcatactcccaaggcactttaaaataatgaaaacatataaaataatatctaagtaattaaagtaatggcaaataaaaacttagcattatatggaatt

SEQ ID NO: 411601 - DNA, 418 bp, Homo sapiens
cctcctcaacatacgctttcgccatctctttactaccatcagtttttcagcctaaaaacctcatagtcattcttaaaacttgtggtaccttaccattgccttccaatacacttacagtccagcaacaagtcctgttgccaacaaatgcaaaatatttctcaaatctttccccttttgtctatctcccttgctgtcaccctagtgcaaaccatcattgccaccaactatgctccagtagtctttcctggcctcctggcctcttgcaatctattctccatgcagaaaccaaagcgaccaaaaaaaaaaagagtaaattggattatgtcatctccttgtcagaaagctctgaatggctacccactgcatttatgataaaatacaaactccttgccttggcttgcaacaccccacatgatct

SEQ ID NO: 411602 - DNA, 386 bp, Homo sapiens
tctgcgtggggactttctctcgaaaataccttctccaaattgcctccagtggggatgactccaagggtcagttctggagcacccaggcaattgcagacagagtgacttcgggtttgtacactgtcccaggtctttccttacctgatatcaccctgggatcttccaggcttaaacaaggagccccttccaagggtccccaaaggaagcagctgtctctgagggtcaagaaataatgctgcttccttcctccagaggggactcctcaacccctctcttgccaccatcactaagccaggggcccaggttaggaggtggagggacatagtgtgcttagtagagagcttgtcttctcttatcatccaagtgagaggaatacacagcttccc

SEQ ID NO: 411603 - DNA, 421 bp, Homo sapiens
aaatcccccatccctgttggagtggatgaagcagccgtggtgcgtccgcacaatgggatctcaccagtcattagaacaagagatccacaaccacacataaccaccactaggatgaatctcacaaacaactgggaggaaaaagcaagacacaaaagaacactcactgtgtgattccacttataggacgtttaaaaatcaagcaaaacccactgacaccaatagaagtcagggcggtggatgggtcgcagggagaagacaatggctgggaggggtatgaaagcttctgggagggccaggttgtgccctgtttcttgatgagaggaccagggacacggaatgtttgccaggtgagaattcattgggctgcacgcttatgatctatgcatttgtctatatatttcaataaaacatttacctaata

SEQ ID NO: 411604 - DNA, 559 bp, Homo sapiens
catgtcccacattggagactggtcagcaccatttaggcacttgaagatggtcccagggcctgattggttcagcaccaagtgaagtcatagtcactatggtgactcacaattgtcctcagaacctagtgccaacagtctgcaagattcaaacactggccaccatgcctggcttccttctggttcaagcctgaataaggtccctcttctgtgctgtcttcctgaagccatctgtggagtcaagcagtcatggctcagggacactctgaagtaggtcccagcacatctgcgtggagcatcaggaggaaggtggatgaatacttaagacccagcctggcctctaaatcggtgctgagcgttttactcagtagacagcttgggaatcatagaaacgatgtggatctgacagagtggctgtggacactgaagcaagccataccagggtggacctggcctttgccgacacgccacacaatcaacccacctctgccccctggggaggatagaaaatccaagaaaatggtgtggatcaataaatccttcccctgatgcaaccattaaa

SEQ ID NO: 411605 - DNA, 472 bp, Homo sapiens
gaactgaaaacaaaatctgtgattctttctctctttcacaaccccacccctgggagatattttcagctttctgatttattttccttttaataaaatattgaatgccattttccctaattatttctcattgaatgtactccttaagtccccttttttcaaataaaaagaataaaaccgaccatgtaatacgacaatggttctatcactactgataattatacattttgttctcattgtaattgccctggtttgaactgtgcttattttagcagaaagcgttcattattttatcaacaactggcagaccccgctggtatttactgacttttctttaaccaaaacaaggattatagctcctatccatggctcagctgctaaatctttgctaagaaatttgggaaccccttttgaatgaaacactgtacaaagctttaagcactctttgcaactgagttgtattaaatgatagaca

SEQ ID NO: 411606 - DNA, 865 bp, Homo sapiens
ggcaaaagcaggtcctgaaggcaggatcctgaagatcaggcaccacctgacagaattctcaagcacctgactcatcacctctgcagtgcatccctttccagaagtccactctcctgattcaccaccagtggaagttttaacaatggaaacaccatctgtgcaaggtgtccacattgctagctgggcggtgaatgattcagctccaaaatcccatttgattgcctgctctttccagacacaactgcagcaaactggattgtctagacacagatgatgagacagagtttagggtgcaagaagctaactagggatcaacacctgtgtaaggaagcaggtggaagcacaattgaagttgagaaagatgaagaggttgaactgccctgcaggccagatagagccttgccaaaccagtggggaactcggaggaagtcctgcctgccagtttcccatgtggagccgaaacagtcgtgcttttatctctccaccttgctcagtcaccagatgcaggccacgcccagaagggtatgtttttctctgcagctcagactgatgttgaggagctgggagctggaagccacctgctgactgcactccctgcagctggtcagcccatccttctcgaggggcatctgaatggcatcttcatcagaatgcaaggctgggtgcagtggcccacgcctgtaatcccagcactttggcaggccgaggcgggcagatcaccggagctcaggagttcgaaaccagcctgggcaacgtggcgaaaccctctctctactaaaaatacaaaaatgagctgcacatgttggcgcacacctgcaatcccagctactcaggaggctgaggcaggagaatcgcttgaacccag

SEQ ID NO: 411607 - DNA, 1068 bp, Homo sapiens
ggcaaaagcaggtcctgaaggcaggatcctgaagatcaggcaccacctgacagaattctcaagcacctgactcatcacctctgcagtgcatccctttccagaagtccactctcctgattcaccaccagtggaagttttaacaatggaaacaccatctgtgcaaggtgtccacattgctagctgggcggtgaatgattcagctccaaaatcccatttgattgcctgctctttccagacacaactgcagcaaactggattgtctagacacagatgatgagacagagtttagggtgcaagaagctaactagggatcaacacctgtgtaaggaagcaggtggaagcacaattgaagttgagaaagatgaagaggttgaactgccctgcaggccagatagagccttgccaaaccagtggggaactcggaggaagtcctgcctgccagtttcccatgtggagccgaaacagtcgtgcttttatctctccaccttgctcagtcaccagatgcaggccacgcccagaagggtatgtttttctctgcagctcagactgatgttgaggagctgggagctggaagccacctgctgactgcactccctgcagctggtcagcccatccttctcgaggggcatctgaatggcatcttcatcaggtctacaattttatgtacatgccacattctgggctttcccactttgaagcaattatcagttatgaatgttaggaacactttgtacaagttttaccgtgaccaaatgctttcatttctcttgggtaaatatctaggaatggaattgctgggtcatgagacacaaacacaacacgtaagcctaggcctatatgggagcaggatcatccacgtcactgtctttcacctccacatcttgtcctactaaaaagtctgcaggggtaataacacacacggagccgtcatctcctatgataccaacaccttgttctggggtactcccttcagggacctgcttggctgttccacaattaactttttttttttaataagtagagagtacactctaaaataacaataaaaatatagtaaatacaaaaaaa

SEQ ID NO: 411608 - DNA, 694 bp, Homo sapiens
aaccaagtgttcatatgggatcaggcaaaagcaggtcctgaaggcaggatcctgaagatcaggcaccacctgacaggtaggattcagaagaagtggctcagacttcctgatgtcctgctcatctccttcatccctctggtctcatttacagctttcttctgctggttgtagggatggctatagcattacagccccactcatgggtggccctgaaggacactggggaaaggaatcttcccagtgggcagaacatctagcaggacattggttgtctagcttaaatggaagaagaagtcagaggtgcatatctatactgactcatagtcgctggacaatgatttggccagatggtcagagacatgctagaaacaagatcagagaattagagacaaggaagtttgcgcaagagatatatggccaaacctcttagaatgcacagcgtgagataaattgatatcttacatgaatgtttgccagagggagcccatggtagaagaggatctcactaacgaaatggacaacatgactcactgtgtagacctcagtgaactacatctgaggagtttgtgtacaatgtggtcatggtggcagggctggagattaggcatccgtggatattgccactgtgctgatctgactaccactaccactgcagagtatccaacttgctaactaccatttagcaccatgctct

SEQ ID NO: 411609 - DNA, 216 bp, Homo sapiens
aagctactcgatgaggcgaggtccgcccctattattcattgtcctaagtcttcatcgtgctgccctttccaggcttctttcctgctcagccactgcctccaattcctgcgcccccagcgtggaaaggcttccatttctctctaccgggggggaggcgggtgagaatgggtctgtaatttctctaagatgaataaaggggcagtaaatgatcttcct

SEQ ID NO: 411610 - DNA, 331 bp, Homo sapiens
gttgctctctgtcttcctccatcaagctgaaggctcacacctgtgtgtgtgtgtgttttagagatgtgagacagatgaggctggtcaaatgtcaacatactgaacttaaggagtacaactgtggagagtagaagagtgatctgcacacattgtcaatggtgccatccctggctttcactgttggtctggcagacccttctctggaacagttttcttctggtcttggaactggcaggatgcccacagctgcctacagctgtctcttttccacttgcctcaatgagctcttatctttcttttcaccattaaaaatcataaatctttttttttt

SEQ ID NO: 411611 - DNA, 3452 bp, Homo sapiens
  misc_feature (1356)..(1356): n is a, c, g, or t
  misc_feature (1962)..(1962): n is a, c, g, or t
gcgcaatgggaagcaatatactggagctgagtgtggatagaaagagcaactttagaaggagcaagcagctaatgcttgcttcctaggaacccataatgaatttgctttctaagtacattcccggtgtttctgcattgggtacgattgtgttcgtttcagaagaaatacgccataaaagcatgcttccactttaatgtttcagttggttcattttattggtctcagtcttctcgtctacttatgcccatcaggaagagtccaatcacaagtgcgcaggtaactttgaaacttgcaacaagcatgctgtctactatctttggttatcccaaaagtattttgtctgggtgtcctcaacatccttttctgtcatttacctcacttcttaaagatgctctccctctcagatttctcttgttctcttctacaatgaacttctgcttcattcactgttactgaattttcctttgccggcattgcactattttattgtgctcactaggtcactggcggtgacattcaagttctgcagatttccagcaatgccacagtactgggcattggctgaagctaatctagatagtaatccaaagagttcaatgaaaagttgagaatcagaacattaggtaaacaggtgtgtgagtgcttgtctgggtgtgggtagaggtttgactgtctgggtctgtaaaagctgacaaagtctccatgctgcccaacttctctgtacaacaagtacttctctgtgcgacaaggccagcttgtcaaataagatgcttcatgagcatatatgtactgctccccgcagtcatgccggcggttggaatgttctaccagagtttgagggtgtcacacttcatttattaatagacactgtgaatcatggccagtggctttgacacttccctggtggtgcaaccctatccgaagaaccttcctcactgtgaaaagctaccttgcagtgtttgtccctaagattgctgctctgactttgcaggaatactaagatgagctgaagaacttgtctaggtcatatcttccacatctgcatatgacggggtttactgccttttgaaaatcagtgaagctcttttaccccaccaaattaagctttttcatcctttctcttaaggttccctgtgctgaaaatctagtctctacttccccttcccagtaggatcagctgtctgtttgaatggccccctgataccacctcagtcttaaggccaaggacaaaatgatgaattagcagcgatttaattctttgtgagattaagatgtctccattgtcaactcaaacttcctgaaaatgcagaaagccccagcatgtaatatcactttaagatgccaaacagctgagancagggggttaatgctactgccacctcatttttatgtcacttagttcctcagataaaagtccattttaatcaaacttttcatcatttcctcgtagccaatatatccttgatgccagttagaatatttgatattaattattcagtcaaaggcctccattatgagtttagttagaatattagtgatttaaaacatgttaagactcatacagtagtgatgtccccaaagtagttttaactgaatcttgatgaaccacatacattaaattctataggttttttactttttccctcattttccatagaaaattccaaactgctacacatttgttggctaagtactcttttgagaggaagagtatgtgcctgctctttcgagagtgccaaatctgacattaccttggacatgaaatctattaagcttggtaagctgacttgcatgttttccctcctgcacatattaaagggaattttagcatttatttcctacttctccagccaaaagaaaagaaggttgttttgtgcctaggcatctgcttagagtattgctctatatctcatttctcataatctttggtagttcttgatgttttcctatcttattgccatnccaccatctgcctcctaatgctcattgccctggaattatggtggtgattttcttgataatgctgtaccgttttgcatgatgcacactgtctttctgcacctacctcctcctgtcttctctgactccagccatttgcactgtcccttgattcaagttcctgggtttgctgtgtataggtatcttagtatcaacctactatagacagagacattatgaataaatgaagtgtattaatttattataacatctgatttgtatgtttgtgaggcctgtgctttatgattatttaaaatgacattatatcactgaaatacataaccatcttggataaaaagttagtgcctcaccaaatgcatgaatacatgatattattcaacaggagtaattaacagtaaaatcactagtcttattttccatttttatataccaagatctgcatgcaaattgtttcaaagatgtcatgtttattcctaaactagttgattgtatttaaatagaaaataaaactaagaacaatcaaggcaagggagaggttgtaaaacctattgcgtgccttctatgtctgtacgttttgcatgccttgtctcattttatcctcactgtccagctggctaggagtcatatgatgctcctttaataaaagaaaaaaatgtatccttgaagtcacagaatcagaatcagaattcaaacccaggactctctggtttccaaggcctttttaatttcacttgaccccacatgactaacattggcaagtcaaggagaggttggaatgcttacatcatctgttttcataagtaatgtgagttcatgagatgggagatatcttagaccatatgaagaatagcccatgttcattgtgaacatcttttaaggttccagagaaaatagaaaatgtcaaaacctacgggttgtaaaaaaaaaaagtaataaaatacaagaaaatagtagggaatttatgggaaataaagaaaaacacttttgaatcacacactttttcttcttttatcactgtaagttttcccaaagtagaaacaagatacctgccttttccttacaattaccctgttcctgttgggaacatacacagagatgtgagtggcgccccctagggctgcacagaccatgtgcatggaccaggtccccagcccctagattgcactctgcaccactcctccacagaacactcagaacaaggcaaggggaaggagttaacatttgttgagcccgtattgtgctccaagaactctggcaagtactttaaatatgtcacctcatttatttcctgtaacaatcctgatataaatattatcatccctattttatggatgaagaaactgagactgggagatgcaaacaggtgtggctaagattgcacacagaactagtgacaggttttggagtcagttcagtattttctgcatctgaaatttctgggctttctgcagcatcaaggtgtctggtactaggctggttgtaaacaggtagga

SEQ ID NO: 411612 - DNA, 364 bp, Homo sapiens
gcaaaaccaatcgggaggctgctaatggtcacgtgaggtgggtcctcacgccctgacgagtccacgggtggaagatgtgcgcgcgcgggttggccgacagtccctacggtggctcggcaggtcctcttaggttcagttctttgctaggactgggtcgagtgatctgaactcgggacaagagtcggtccgccaagtcctctgaaattcctaacccaggaaagaactctctgcgggagtactggtgtcaagtcagagacgttaaggtgtcgaatatcacaaaacatttaataccaccaagaactcttcttagtctttttcctgttttactactcttgtttactatttgattaaacgtgcgtgcatg

SEQ ID NO: 411613 - DNA, 1050 bp, Homo sapiens
actttgcggccactatgaggactgagcttcctctccccaggacccgcatgggagagaccgcggcttcgagacacctggggacacctggggacacctggggcggcgtccgcggtgaggactgggagacgctgctgcatctccgggacaccacttggggccgaggccaaggacccacccaggaggggccatggcttcgagacacctgaggacacctggggccacgtccgcgatgaggacatctctgggacacctggggctgcatctccgggacacctggggctgaccctggtacggggaaaggaggaggaacacagagacgccctcgtgaggtcggggaccagcaggcaccacagtctaaggccaatgaaacaggcgcccctagatgagtgctcggtgtttgttttgttttgttttcttttgagaaggagtttcgctcttgctccccaggctggagtgcgatgtcgcgatctcgactcactgcaacctctgcctcccgggttcaagcgattctcctgcctcagcctcccgagtagctgggattacagtcatgcgccatcacgcccggctaattttgtagttttagtagagacggtgtttctccatgttgatcaggctggtctcgaactcctgatctcaggtgatccacccacctcggcctcccaaagtgctggaattacaggcgtgagccactgggcccggccagtgctttgtgttttaaggctcttttgttaacgcagtggaaacaacacaggaaatggaaaagcaggcacattatcattctcaggccactgcatttagcctgggcgacagagcgagaccttgtctcaaaaaacaaaaacaaatgaaaacaaaaacaaaccattttgtgtgtctaatggaagtgacctcgtcaacaacagtcttttgttgagaaagtctgtttaattggcagtgtatttgtaatggtacataaaatgacgtctgctttataagcattctcattcctatattagatgaaatgtattaactatatcaagctttgatattataccataaaattacttgaagaaa

SEQ ID NO: 411614 - DNA, 434 bp, Homo sapiens
acagcatctcaaggcagaagaatttctcttagtatagaacaaaatggagtctcttttgtctacttctttctacatagacaagttaacagtctgatctctctttcttttccccacagctgcccttattattttttccttcatttcaactttgatgaattcaaacaggatacaatttggggaatatatgcttataatttgcacttgagctattctgtccgagtatgccccaggacattttatggaaataccatgcagtgcaatttcagactctgagcatctaaaaacctgcctcagtatgcatgaatattcactatatgattatagttctacatgcctttgtatgtataagatccatggcttgcatttgccttgatttttatgtgtggtaaaaataaaaatatagcaagtgtatacaaatattaggaaatggaaaa

SEQ ID NO: 411615 - DNA, 467 bp, Homo sapiens
ctttaggagcagaaaagcagcaagccaagcatgctgggttcccagaagaccaacactatattctgaagacaccaagaagatattcagtttttccccactcagagatgacatgattgcagacatgacatccatgagctcaaagctctcatctccaaataaacattgaattcagccaaacattggtcaagcacctactgccagcagacatgttttgcataccagtgaaactagtgacatcggctggtctaaaggaccccacaagcagttgactcaaagaacaaagtttccaagttctgattttcataccccttcctcgatcaatcaacaaccacaattttctagccccttgcccttcataattctcttaaaaaccccagcccagaacccctcagagatggattcgagggtctccttccatctccttgctcagccaccctacaatcattaaaggctttctctgctgcaaa

SEQ ID NO: 411616 - DNA, 431 bp, Homo sapiens
gtaggggtacatgctgcagtgggtagaattgtgttccccaaaaagagatgctcaagccctaaccctggtatctacgaatgtgatcttatttggaaatagggtctttgcagatataattagttaagatcaggtcatactagagtaggatgggcccttaatccaatatgactggtgtcattataagaagaggaagagatacacaagggcacacaccaggagaatgtcatgtgacaatggaagcagagattggagagctgtgtctataagccaagtaacatcaaggattgctggcaacaccaaaagctaagagaaaggcgtggaacggactcccaccttgagccttcagagacagcgtggacctactgacaccttgacttcagacttctagccagaactttgagagaataaatttctgttttttaagaccccgt

SEQ ID NO: 411617 - DNA, 735 bp, Homo sapiens
ctgcctctccaatctctttcacagcccagccctggaaggtggaaaaagaaaagttgacatggaatgtttaggaagcaccattggtccaggtccaggatcggggcagccagcatgtcctctaatctggcttcactgttgaaatccagtcgagcaagcagggcccaaaccactgcgagaccagctcggtcgggcccaaaccaccgcccactgcgagaccagctcggtcgggcccaaaccaccgcccactgcgggaccagctcggtcgggcccaaaccaccgcccactgcgggaccagctcggtcgggcccaaaccactgcccactgcgggaccagctcggtcgtggagaccctaacccagcggcgctagaggaattaaagaaacacacacagaaatataggtacctcgcaagggttttttgcatgtctgatacctacggctccaacaggacccactgactgatgatggctccacctggacctgccaactactcctgcagccccacccagaagcggttcagcacacgggaggatcctgtctcacaccctacgatggccccccgcccccacaacccatcagcagcaagcacccactgccaagctaccccaccccttcccccaaactacctttggaacaccctagtccccaaattcttggggagactgatttcagtaatcatcaaattctggtctcccattcacttgtctctgtgtgaattaaaccctttctctattgca

SEQ ID NO: 411618 - DNA, 488 bp, Homo sapiens
gagccaccgagcccggccacaaaaattgtatcattgagaaaattatgccaattggggaagatctgatgtagccaaaccccctttgacctttagccttcaagctgccttcagttattcttgggctagctttgggagatgtttatagtttacatgataatagcccctccccaaaactcaactgtatttgtaaaactaatgaggggccaccaggctagggagaggagaggagcctgaatttggctaagatgtagacataaacaattatcagccattattccagaggtcctgcagataacaatgctattgtaacctaagattggccttttgcagtacctcgcaagggttttttgcatgtctgatacctacggctccaacaggacccactgactgatgatggctccacctggacctgccaactactcctgcagccccacccagaagcggttcagcacacgggaggatcctgtctcacaccctacgatggcccc

SEQ ID NO: 411619 - DNA, 1915 bp, Homo sapiens
aattgtggtcagcttttccatttagtgttttcacatacgttatcatttaatcctcacatgaggcttgcaaagtacctattattatcctcaatttacagtggagggaactcaagcccagagtgaatttagggcccacaccactgctcagtaggggagctgttctgggccctgcctctcttcccaatactcagagtgcctcttgctacagctggccctacagggaagggaaatgcactgatctgtcactgctgtcgaatcccccaaattcccttcacccagttcctcgcacccagggtagctgccctttggggcgaagggcacaggggaaggggccttagtaggttaattattaatcctttgcgcctcagggcaccacgggcttctgtcccctcctggaggcggagggacacggactggctaggcgctggtgagggggcggcggtcccagcagcaggcatgggagtggcggcgcggcccccagccctgcggcactggttcagccactcaattcctctcgctatcttcgcgctgctgctgctttatctcagtgttcggagcctaggcgcccgctcgggctgcggacccagggcgcagccctgcgttccaggggaaacggcgcccttccaggtccggcaggagtcgggaaccctggaggccccggagaggaaacagcctccgtgtctgggccctcgggggatgctgggccgcatgatgaggcggttccacgccagtctgaaacccgaaggggatgtggggctgtcgccgtacctggcgggatggagggcactcgtcgagttcctgactcccctcggctccgtcttcgccttcgccactagggaggccttcaccaaggtgacagacctggaggctcgggtgcacggcccggacgcggagcactactggtcgctggcggccatggcggcgtgggagcggagggcgggactgctggagcagccgggggcggccccccgggacccgacccggagctcgggctctcgcacgctgctcctgctgcaccgcgcgctgcgctggtcccagctctgcctccaccgggtggcgaccggcgcgctgggaggcccggaagcgggcgtgcagtgcagcgacgcctaccgtgcggccctgggtccgcatcacccctggctggtccgacagaccgcccgcctcgccttcctcgccttcccgggtcgccgccgcctgctggagctggcgtgtcccggagccaccgaggcggaggcgcgggccgcgctgctccgggccgccggcaccttggaggatgtctacaaccgcacccagagcctgctggccgagcgcggcctgctccagctggcctaagacggcggctgcggggaccggcgggaacggagcggaccgcccggggtggggccgcgcagcccggggtcagtcctgcagcccgcgccgcggccgcctccgtatcccgcctcttccgtgacgtcgccgcggcgagggccgcccccggcagggaatggcgttgagctccctctgtccgcagtctcggaaagacgggaggagctgtgaggaataaaaaagcaatatttggcagcgtcgacgtagggcgttttgtgtgatgacgacaggcgcttaagggaaataaaaaacgaaggtgagaagatgtgtcatctctgttctcggcagccgagagactcacgctcccccggcctatcgtagtcactcccgtggcttcggttgccaaacacacgctgagtctccagcccagacttgtccctgagcttcacccctgtgcagccaagtatacagcaagcatcctgcacactccacagacgctgcaaatgcaacgcgtccaacacgggtcccaccaccatccccctaagaactacacctcctcctgtgttccctgtctctgtgaataaatggcaccctcacccttcagctaccc

SEQ ID NO: 411620 - DNA, 1433 bp, Homo sapiens
aattgtggtcagcttttccatttagtgttttcacatacgttatcatttaatcctcacatgaggcttgcaaagtacctattattatcctcaatttacagtggagggaactcaagcccagagtgaatttagggcccacaccactgctcagtaggggagctgttctgggccctgcctctcttcccaatactcagagtgcctcttgctacagctggccctacagggaagggaaatgcactgatctgtcactgctgtcgaatcccccaaattcccttcacccagttcctcgcacccagggtagctgccctttggggcgaagggcacaggggaaggggccttagtaggttaattattaatcctttgcgcctcagggcaccacgggcttctgtcccctcctggaggcggagggacacggactggctaggcgctggtgagggggcggcggtcccagcagcaggcatgggagtggcggcgcggcccccagccctgcggcactggttcagccactcaattcctctcgctatcttcgcgctgctgctgctttatctcagtgttcggagcctaggcgcccgctcgggctgcggacccagggcgcagccctgcgttccaggggaaacggcgcccttccaggtccggcaggagtcgggaaccctggaggccccggagaggaaacagcctccgtgtctgggccctcgggggatgctgggccgcatgatgaggcggttccacgccagtctgaaacccgaaggggatgtggggctgtcgccgtacctggcgggatggagggcactcgtcgagttcctgactcccctcggctccgtcttcgccttcgccactgctccagctggcctaagacggcggctgcggggaccggcgggaacggagcggaccgcccggggtggggccgcgcagcccggggtcagtcctgcagcccgcgccgcggccgcctccgtatcccgcctcttccgtgacgtcgccgcggcgagggccgcccccggcagggaatggcgttgagctccctctgtccgcagtctcggaaagacgggaggagctgtgaggaataaaaaagcaatatttggcagcgtcgacgtagggcgttttgtgtgatgacgacaggcgcttaagggaaataaaaaacgaaggtgagaagatgtgtcatctctgttctcggcagccgagagactcacgctcccccggcctatcgtagtcactcccgtggcttcggttgccaaacacacgctgagtctccagcccagacttgtccctgagcttcacccctgtgcagccaagtatacagcaagcatcctgcacactccacagacgctgcaaatgcaacgcgtccaacacgggtcccaccaccatccccctaagaactacacctcctcctgtgttccctgtctctgtgaataaatggcaccctcacccttcagctaccc

SEQ ID NO: 411621 - DNA, 535 bp, Homo sapiens
ggcggagggacacggactggctaggcgctggtgagggggcggcggtcccagcagcaggcatgggagtggcggcgcggcccccagccctgcggcactggttcagccactcaattcctctcgctatcttcgcgctgctgctgctttatctcagtgttcggagcctaggtgagctgccccttccctcacttgctccgggaggaagcccggaatccaggccctcacgactcaagcctctttctcgagccctcaccgctccgcttctcctctacccaggcgcccgctcgggctgcggacccagggcgcagccctgcgttccaggggaaacggcgcccttccaggtacgctaggcgcaggattgggcgcgggcgctccaggagggaccagaacagggggacgtggagccaggctgagggtccggcaaagggcgggtcctcccccggtctaccctctcccgtcggaagctgagcgcacagcagaagagccgccagctaaaccttcggaacaatttcttcagggcagaatctgctcccacctc

SEQ ID NO: 411622 - DNA, 424 bp, Homo sapiens
cggccccccgggacccgacccggagctcgggctctcgcacgctgctcctgctgcaccgcgcgctgcgctggtcccagctctgcctccaccgggtggcgaccggcgcgctgggaggcccggaagcgggcgtgcagtgcagcgacgcctaccgtgcggccctgggtccgcatcacccctggctggtccgacagaccgcccgcctcgccttcctcgccttcccgggtcgccgccgcctgctggagctggcgtgtcccggagccaccgaggcggaggcgcgggccgcgctgctccgggccgccggcaccttggaggatgtctacaaccgcacccagagcctgctggccgagcgcggcctgctccagctggcctaagacggcggctgcggggaccggcgggaacggagcggaccgcccggggtggggcc

SEQ ID NO: 411623 - DNA, 417 bp, Homo sapiens
tctctttccttcactatcaatattttggtaagtcactaaattatatccttcttattttcaacctcatcttaagtgttttctacctacctggaatgcacattcccatatcccctgtgttactctttcttcaaatttttctttcaatgtcactgcttatgtgccaggttaagttacttgcctccacttcatgctcctatagcactaatttggatgtctagtaaaacctgccacattattataggtggagccaaaaaatcattgcattattggctattaaaatacagtattttggccgggcgcagtggctcacgcttgtaatcccagcactttgggaggccgagatgggtggatcatgaggtcaggagatcgagaccatcctggctaacacggtgaaaccctgtctctactaaaaataca

SEQ ID NO: 411624 - DNA, 389 bp, Homo sapiens
tggtttgttggaagatttcctggcttttttttctattatcaactgggctgccacatatgtctttatgcctgtttcatgataaatacgtgcaagaggccaggctatgcaaagtgccagctttacaagatcatgagcagctgttttgctacgtggtattgccagtttagactcacacaagtggtaaagaagcatccccagtgtcctaaatccttgccaacacttagtgtcaccaggcttcttaatttttaccaatctggccagtggataatagcattgaaaagttatttttattgtgatttggagtccaatattttttctgtaagaaatgcatgtacaatgttataagaacatgcaaaaatcaaaatactttataaatgttcactttataa

SEQ ID NO: 411625 - DNA, 667 bp, Homo sapiens
cgatgcgggtgcaccagaagatgacctactcctcgaaagtgtcggctaagcacaccagcctgcggcggcagctgcagctggaggacaagcaggaggacctggaggcgcgcgccgaggccgagcatcagcgcgccttccgcgactacacgacctggaagctcaccttgaccaaagttgccggagctgaaagtaggtgagtacaatacagcaagatattttgagaaagagaccctttgcctaacttttattacagtatattgttataattgttctatttttattagtcgttattgtttatcttttactgtgcctaattcataaataaaacaacttcatcataggtagctatgtgtgggaaaaaacttagtgtctatagggtagggttcaggcatcccctgggggtctttgaacacaggctcctggataagggaggctgctgtattgcgtgattcggaaggtgggcagtgtacagtgggcgcaggctgcacagcgtagaagtgggcggttcctaagaaagagcatggagctggacctaggtttcctggcttccgtggcagcagctgcagcatttcacagctttgtggtcatacccaggtcacctgagccctttgcagctcagtttcctttcctggctgataacagtaccagcctcatggattgtggggat

SEQ ID NO: 411626 - DNA, 619 bp, Homo sapiens
cctgtcttctctgcttcctccccctgcaggtctccatggtaggagtgcagctttctcccccagttactttccagctccgggctggctcaggacccgtgttcctcagtggccaggaacgttatgaagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaagaaaaaaaagctggaaaaagaagaagaggaaataagagccagcgttagagacaagagccctgtgaaaaaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagga

SEQ ID NO: 411627 - DNA, 401 bp, Homo sapiens
cagcgttagagacaagagccctgtgaaaaaggtgagtaggaccagagggctttggcccttgggacaggcgagtattctctggagggggctgcctggtatggagaagggaacgggaccctggagccctgccttccctccacaggccaaagccacagccagagccaagaagccaggattcaagaaatgaggagccacgccttggggggcacggtgcaaagtgggccttccctgggctgtgctgcaggcacagggtgcccctgtccagcccctccacctgtgtctgaatgcaacaggggtgttgcgggggcaacatgagagcccctcacccccaactctccactttcaggaggcccccagtgaagagccccacctcggggtcacaataaagttgcctggtcagg

SEQ ID NO: 411628 - DNA, 566 bp, Homo sapiens
aagcatcagacctaacctgggaggaggaggaggaagaagaaggggaggaggaggaagaggaagaggaagatgatgaggatgaggatgcagatatatctctggaggagcaaagccctgtcaaacaagtcaaaaggctggtgccccagaagcaggcgagcgtggctaaggtgggggaaggagcgtggctgtttggaaggaagtggtacccctacagaagcacttaagaggggtgggccaccgggagcctgggccagcctcccagaatgagtgtacaggatgggccaaggccacctcagctagttctggccaggagctcagcggggaccttgtggactttgggaatctgttctggctctggactttgtctgaactctcataatacactgttttttggttcccagaaaaaaaagctggaaaaagaagaagaggaaataaggtaactctttctacctattaaattagccaaagtctccagctgagatatacagtgttagaaagaatactgtgctgttgggatgtacgtgtacaaatgtacacacggtgtgtctacctgcactcgcaggcac

SEQ ID NO: 411629 - DNA, 445 bp, Homo sapiens
cctccaaaaaacaataatcccagttttatcatgacaaaaaaaatcagaagatcccaattgaaaaacgttttgcaaaatacctagtgagtactcctcaaagctgtcaaagtcatcaaaaacaaggaaagtctgaaaaactgtcacagtctggagtagcctaaggatacatggtgactaaatggaatgtggtttcctgaatgtcacctgtaaggaaacagcaggtaaaaatgaaggaaattggaataagtatggacttcagttaataatatcaatatagtttcattaattgtgataaatgtcccacactaatgtaagatttttaaaataggggaaactaggtatgtggtgtatgtgaattctgcactatctttgcaacatttctgcaaatctaaaactattctaaattttaaaaaagaattaaagcctgctttttattatctgaact

SEQ ID NO: 411630 - DNA, 478 bp, Homo sapiens
aaataaaattatagcactttactaaaaaagggatgtaataatgttatttaacgaagtattttatatatgacttgccactattctatacataaaattttttttcttaattctttcctgtgttaactagggttattttctatttaaggtaatcctgctggagaacagatgctatccaatatttattacaacacatgagttgtgttgtttcacaatactgaatttcttaggtgaggtattttatttaaaaaggagggggaaaactcctatattttcttgacttcaaacctgtggggccaggggatatagattgaaatgctccgtatttagtcttggggatcaggcttgtttagtacaataccatggttttagaagtctgtactaggaacatttttaaaatacattttttatatttcagatgtaatgcagtgcacttttatttgaacaataaaaaaacccataactttttgagaccatgaag

SEQ ID NO: 411631 - DNA, 345 bp, Homo sapiens
ttctggtgaatttcacatttccaagtgctggaagacgtaagactggttcatctaattactagcaaatttgttcttgtaaaaactactttttttactcatttaaataaaataatttttgggggtagcattaaaaaaaaaaagccctagttagcttccagtaatacagttgattaccagctttgatgatggaacacaagtgaatgttgacttccaaaagattcaaacccaagactggaggcattgaggggaaaaaatactacaatttaatacttgaaagatgttaataaaagtcgaacattacaaatcataatattgaaataaattcaaaatatttatcttttgagc

SEQ ID NO: 411632 - DNA, 336 bp, Homo sapiens
attaaaaagataagtacttacaataaaagtgtggaaattctaacaataggggaagtatagggcagtatgtgatcacttggcagccaaacttcttgcttcctatgtaagactctcacagtcagactggagctgcacatctctgccgctgcacaacacatggagaatagtctgctgtatcctagccttgccaagccctttcaggaccccatgtctttactggattgcctgtccacttccccacgcccccgaccctcatccccgcatattattttgtaacatatttcttcatggtatcccagctttaaagtcttcaatgaaaccttttaaactcctaca

SEQ ID NO: 411633 - DNA, 471 bp, Homo sapiens
ggttgtatttcctctatcaccaggtccatttccagaactaacccaagtcttgagtcagaatagcaaggatgcaccttctccattctaagggaagaactaagtaagaatctctcttgggtatgtagacaaaggagataggatagacagaatgccttagaaaccaacgaaaacaaatcaaactatggtgcatttattcacttacctttctatttcacagtaatacagccttgatttccagaattaaattgtacgttgtcagtaaaagcccaacactttttgttgttgtttcaagctacagtcactttgttttggagctaagtagatactgggcctctttctttcctgacctttgtgatgattttgtaagaaaaacattccaccggcagcctgccttcactccacttttaagctcttcttaggaagctcacatctggtaagtgcagatggctatcactaaaggcataatacaaa

SEQ ID NO: 411634 - DNA, 520 bp, Homo sapiens
agttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggaggtagcctctcttgtgtcattttcttttgaaaaataacaataaactgtttatatcttgaaaaaa

SEQ ID NO: 411635 - DNA, 258 bp, Homo sapiens
caccaaacaccccaagtgcctactgaagagcaagtttaggattaaacctctgcagaacaggaaatgggcttgcatcctagctactcaaagctggtcttcctggcactcagcctgatccacctctgtgttcaactctaccgtatgatggacaagggcgtcctcagctactggcgaaagccaaggaactggctggaggtagcctctcttgtgtcattttcttttgaaaaataacaataaactgtttatatcttgaaaaaa

SEQ ID NO: 411636 - DNA, 832 bp, Homo sapiens
agttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggagctctccgtggttggagtgagcctcacctactatgcagtttccggccaccttgttactcttgctggagatgtcactaaccagtttcacagaggactttgccgagcatttatggacctcacccttatggcatcatggaatcagagggctcgatggctccggggaatcctcttattcctcttcacattaaaatgcgtctatcttcctggcattcaaaacacaatggcatcctgctcctccatgatgcgccactcactccccagcatctttgtagcagggctggtgggggcactgatgctggccgccctctcccacctgcaccgatttctgctctctatgtgggttctaccacctggcaccttcacagacgccttcccc

SEQ ID NO: 411637 - DNA, 887 bp, Homo sapiens
tcttctgttagacccgttgcaccggcatttggatccggtagggagccccatcaaagccagggaaccaggaaaggtttggaatctccctgtgtagactatgtggcttcgactaatgtcataacactaaggtcaaactctttaactcggccatgattattcacaggactcttcggagcttcaaagtagaccaattttcacaatagatgctgagggctcagcagggtccgcacggggtctaaggaacgcagcaccgaagccattctgcgttgctcaagcactccgcggacacgcgctcggctctcacatcctggagatgttcgttatcccgggaagatgtttatcagaagagaatttcaaacagaataagtaactttttagtaaatgtcctcaattaaactcccgccttaaggcaactgttgaattttccccaatgctggaggatacatgtgatgacatgaaatgttcctattttccaaagttttcatctaccaagtcgttcatgtacggtttagcaccgttaatataagttcactcctcaaagtaataggttctgtgacagaagattcttggtcctaaatttctgattcaaaaatgggaaaaaattccaagatataaaagctgttcaccagtattccggttaaatgtataacatcatagaacaatatgagtgatcattgagtcacctttcccagatgtctcacagaaaacctcctctgactataatgcccatggaaaatcatcttaattccagaaagcgggggctgacgggacactgttgagagggtgagtcacggaaaatcacgaatggtggcaggcgccccgcctcagttcccctcgggagagggcacccgccagtgcggaccgccaaggggcgtccaggacaaggg

SEQ ID NO: 411638 - DNA, 531 bp, Homo sapiens
gagacacctgcaaaaacacttgcaatgcaagactcagccacaactgagcctcagagtgtgacatctaggggacaccttgacaaagaaccacaggagaaaccaaagagatccaacattccgctgctgccaggtgttgaggaaatgcacacaccctcatgagagagacacaaaccatcacagagcatcaggttcatcttttctaacagcaatgagttcaggaagtggatgaaacttcttggcctggagaattaaaaaaaaaaaaaaaagaaagaaaggaaagcactgtgagacttttgccccatcacagattgaaggaaaaggtgaaaaaaacagaatgtagaagtcataaaactgcagaggcctattatctaaacatctgacatgacattgccccatcttataactgaagttctcaagactgagtgaaaaaatcaagaaagaacatgtgttctgagatagcatcaatagtatgttctttctgtaaataaagcacattaatgtactgaataaaatggatttcaaaatttggta

SEQ ID NO: 411639 - DNA, 1176 bp, Homo sapiens
tcttctgttagacccgttgcaccggcatttggatccggtagggagccccatcaaagccagggaaccaggaaaggtttggaatctccctgtgtagactatgtggcttcgactaatgtcataacactaaggtcaaactctttaactcggccatgattattcacaggactcttcggagcttcaaagtagaccaattttcacaatagatgctgagggctcagcagggtccgcacggggtctaaggaacgcagcaccgaagccattctgcgttgctcaagcactccgcggacacgcgctcggctctcacatcctggagatgttcgttatcccgggaagatgtttatcagaagagaatttcaaacagaataagtaactttttagtaaatgtcctcaattaaactcccgccttaaggcaactgttgaattttccccaatgctggaggatacatgtgatgacatgaaatgttcctattttccaaagttttcatctaccaagtcgttcatgtacggtttagcaccgttaatataagttcactcctcaaagtaataggttctgtgacagaagattcttggtcctaaatttctgattcaaaaatgggaaaaaattccaagatataaaagctgttcaccagtattccggttaaatgtataacatcatagaacaatatgagtgatcattgagtcacctttcccagatgtctcacagaaaacctcctctgactataatgcccatggaaaatcatcttaattccagaaagcgggggctgacgggacactgttgagaggatccaacattccgctgctgccaggtgttgaggaaatgcacacaccctcatgagagagacacaaaccatcacagagcatcagaagtggatgaaacttcttggcctggagaattaaaaaaaaaaaaaaaagaaagaaaggaaagcactgtgagacttttgccccatcacagattgaaggaaaaggtgaaaaaaacagaatgtagaagtcataaaactgcagaggcctattatctaaacatctgacatgacattgccccatcttataactgaagttctcaagactgagtgaaaaaatcaagaaagaacatgtgttctgagatagcatcaatagtatgttctttctgtaaataaagcacattaatgtactgaataaaatggatttcaaaatttggta

SEQ ID NO: 411640 - DNA, 772 bp, Homo sapiens
ctctgtgcacactgccactttcaccatcccatatccacgcttcgcagagacacctgcaaaaacacttgcaatgcaagactcagccacaactgagcctcagagtgtgacatctaggggacaccttgacaaagaaccacaggagaaaccaaagaggtgggtaaagaaccaggagagaagactccagagaaaggtcaagacccgggggcaggcaccaaaaaaagagatgagaacggcaaactttgccctttcgcagcccaaagtcctccaagtaaatgtcagaagccagcaaatgccttggggagctgatacggagccctgactcatctctggaggagcagaagaggttaatcagaaatctgtgcaagtagaacaaggggtcggaagactgatctagctacacgggaggccaaggtgacgcggagggactcactcacagatgctgagggctcagcagggtccgcacggggtctaaggaacgcagcaccgaagccattctgcgttgctcaagcactccgcggacacgcgctcggctctcacatcctggagatgttcgttatcccgggaagatgtttatcagaagagaatttcaaacagaataagtaactttttagtaaatgtcctcaattaaactcccgccttaaggcaactgttgaattttccccaatgctggaggatacatgtgatgacatgaaatgttcctattttccaaagttttcatctaccaagtcgttcatgtacggtttagcaccgttaatataagttcactcctcaa

SEQ ID NO: 411641 - DNA, 287 bp, Homo sapiens
tccctactagaacagaagctgcatgaagacaggggtctcatctgccttggacatcactgaatcctatgcacggagcacaatgcctggaacgggaggagctcaatggttactggttgaattaatacactgaggaaatggatcagctgtagacaaccttactttgttctctcatatctctttcccacctgctggccctgcctttccatttaaatccagagccaagcacacattccttactatatatttttttgtactgattaaaatgtttcataaacttttaccacata

SEQ ID NO: 411642 - DNA, 1117 bp, Homo sapiens
aaaacacctcagcatggcgtggggaagcaaaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcgcccttcagaccaggactttattagatgatgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttca

SEQ ID NO: 411643 - DNA, 1140 bp, Homo sapiens
ggatgagcacagagcaagaagctagccacgctgggctcctcattgcctagctcaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcgcccttcagaccaggactttattagatgatgagaacgacagtctgagatactcggcctttgttttgtttgggcaattggctgcctttgccgggaggaaatggaaaaaatttttcaccagtcaggttaagcagacacgagattccctcctgatccatttacaggacagaaatccccaggttgccaaggcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttca

SEQ ID NO: 411644 - DNA, 984 bp, Homo sapiens
ggatgagcacagagcaagaagctagccacgctgggctcctcattgcctagctcaggaattcagggctgggaaaatttagccgagtcatcacatttggctactacccgggaaagcagccctcccgagtcaggaacgggctccggttcatcacgtggcagccgcctgcaggagccgcagttccatggaccaaagacagaggagaatcctgggccagcccctttccatccctacttcccagcccaagcagaaaaggacatcaatgatatctttcttttccaaggtctcttggaaactgaggttccagaagcgggagcctctgaagaatgtgtttttcatcttggcagaaagagctcgggaccccagtgctaaaaagcgtcacatggcaatgagaaacttgggaaccatggcctatgaagcccctgacaaggtgagaaagtataagaaaattgtcctcgacctgctggtgtatggactgtatgaccctgtgaatttggaagtcatccatgagagtatgaagactctgaccgtcgttctgggcaagatccaggggaaaggtttgggttccttcttcatagatatcgcccttcagaccaggactttattagatgatgcttgcaaaacaacatttcaagcctgttctccatatctgaaactaaaggaggaatacagcttccagagtgaagaagatcaaaggaacactaagctctaccagcagctgagccactatcatccagagatcctgcagttcttctacgcaaataaaattctgtaagcgcagagcagcagggaaatggttctgtatgagtgcattgctgagccatcatgttcccctgttttatctcactggatgcctcttctcactgcttgcctcttgggattgtaatgggaaagagggtgctgggagagcaatcaaaggcaaaaataatacatggaattgtatgattttatctaaagtaaaattctagactgctttcacttatttca

SEQ ID NO: 411645 - DNA, 292 bp, Homo sapiens
tatgcaggccccagggcaacctgagccatggtcttcatctttcctgtctctttgagaattagtgagaaaattggctcatctgggattctacccatagaaattccccacagagggagagacaattagcaaaaggaaaacatctaaaaatagtcctttgtgctgcagcggaacacggttttccgatacctccaggatttggggctgcagttggacgttttccatctcttctaatagcactgtaacaagttgtcttgaataaacacgagctcgttagccataagaaaactttaaa

SEQ ID NO: 411646 - DNA, 460 bp, Homo sapiens
atttactataatatctcatgttttttttccattaagctgtttatatgtaagcaacattctaaactggttttttgttttgtttgtttgtttgagacaaactgtcactgaggttgggagtgcagcagcatgatcttggctcactgcagcttcaacctcctgggctcaaggggtcctcccacctcagcctcccaagtagctagagctacaggcacgcactaccatgcctagctattttttattattattattttttgtagagacagggataagatctccctgtgttgcccaggctggtcttgaactcttcaggttcaagtgatccccctgcctcaccttcccaaagtgttgggattagaggcatgagccactgcacctggccataaacaagttcttaaatacccagtacacaatattgtttttgtttgtttgtttttgacacagagtatcgttctgttgccca

SEQ ID NO: 411647 - DNA, 975 bp, Homo sapiens
gtccagtgttcactcctccctgtcaccgctccccttctgctccagaagttgttctctttttctgtcatgttctaacttcctctggtgatgtcttttgagcaaaatattatgtggcaaaaaagaaattggaacaacttcacagggtgatcttgtaaggatcgtttcagtctaagtgctgggcattttcttaacgtcattttgaatccaaatcgcatttctaaagtgttaactctcttagctctcaccttgtatttactggtttagacaaagaagtgtatacttaataatgaaaccagagaatgttcagatttaaatccaagaaaattgcttttgtcattgcagcattttcaaaagattattcccaaaggactacacaagaggaagaagcagacctcagtcagaaaaaggtctgaactttttataaaggaaaagcctgaactgaattctcaaaaatacttgatctgagttatattcggagtatgtagttgaaaataggaacttatgggtggtatttaagtgtagctaaaaaaagagcatcaactgttgcctagagtaggtgagttctttccaagagaaggtcatggaaacctggtagcaacagtatccatggaggaagagggcttggatgcctgtcctgtgtaagtcggagagccttttaagagaaaagctaggtttgcaagctttttaagagaaaagctttaaaggttctggcttaaaatatggaatattgctgcttttttcagtaaagtaaatcaagctgagttaggtgatgaaaggtgcgtggcgtgtttccgcttctgccctccccgtggaggtctggcagcctgctttcgctttcgatcacgtgctcatcatgggcagaataatgatgctgcttttggtgtggttcagaccatgaatgaaaaatggtgacgataatgagggtaatatttgaagtaactgaagatccacaaatcatgttcatgtgttttctta

SEQ ID NO: 411648 - DNA, 400 bp, Homo sapiens
tgaagaagaaaaccaaacccagattccatattctcccaatccaggatcttgtcctatagtagtatgttgccaccacctgaacatcagtctagcagaccttttaccttattatgcagaaagcacacttggcatgaaaagaaagggtatcctcggctagatttgcttctgtcatggctgaaaaggtgaagtgacccgctctgaaaacatgaagcccttggactctcaggtcactgcatagggtgttctaattagaaaaacaagtgtagcattttacccaccaacacagtggtgacatttggtgaagttctaaaaatctttaattattacttacactttacatatttaccaaaatgttatgtatctccttgatatttaataaaatcacttttaaaatccaaaa

SEQ ID NO: 411649 - DNA, 451 bp, Homo sapiens
ctggtagtatgttaattcattgctttttatttttagtgaatctgttataggtttttgtattttggttaccatgaggcttacaacaaacataacaagttattttaaagagatggcaacttatgttagatcacaaagaaaagattagaaacaaagattctgccactttaaataggaattcacaggatgaatacttaaaattaaaacactgcaggaaaattagcctgtgagtgaagatctggttcaggagtacactgggaaattgtctggcatcttatctaaaccttacgctcaggtcttctcctaatgtctttagaaatttcatggtttctgattgtcaagccatttccacataggaaatgcaagcctataactcaactctttgggagaataaatatataaatagttattccaacagtggacttttatcacttaccctgctttattatacaaa

SEQ ID NO: 411650 - DNA, 458 bp, Homo sapiens
cggacaaactttaaagatttccagaagttaaggaaagagatgcaaaagcagagaaaaggcgacttgtcttttcagtgttgcattactgtgtggcgtaaaacatcttctaaaaagctcctgtggccgggcacggtggctcacgtctgtaatcccagcactttgggaggccgaagcgggcgaatcacttgagaaaagttctaggaaaaagcccagccccagaaaaacaaaaaccaaaacatttagatccagaaatgcctgagtgaagatgaactttggtgaactccccttacaatcctgctaaaatccccacccagggaagagcttattcaccattttctatacatgcaacatgtgtagaagcatgatcggcaattgtgtcttcgctgcctttactccacctgtacatacaatgactgagctaaccagcccaataaaagcactgttttcactgttgctcg

SEQ ID NO: 411651 - DNA, 953 bp, Homo sapiens
attattttccagatgaggcctgctcaagagcatttggctgatgggggctgaaacctctcactgcaaccaggttcatttggctccaagtcctgtgtgctctttatgaagtcatagcaaggcctggactagggtgagaaaggacaggtgcctgtgaggcaggacttaaaggaggcgctggccctcaggggcatgcgagggcagggtgagcacctgagagtgagggcctccttaaagtctgtggtccagggtcctttggtcccctaatcccagagcagaaaagaaagccttcaaatccagctgctgcctgaagagcctcagactcactcccctggggcagcaaagtgcatttctttacccacaaggccctgtagtgctgactggaagatggggctgtcagggactcatgggaaagaatggcacattggatacaaactcattcggcttagttttaccctgtggctgcccctgtagtgtcatttgtgacaccaggaatatgttccataccaaccgaatagcttctcttcctattcgtgccagtgcatggaactatataatcattcatctattcattaattcatttatttgtagccttcctctttatataggcttagagagccactactcgaagccaagccttacgtcaggcagcagagataccaagatgaggttgaagaaaacacacggctttctccactcatggactccaatgaggatggcaacaacatgggctgagacttgaccttgtgactccagcctaggattatataaggatgtgactgaccttagaggatttcacgggaacttagctgtacacgtggaacccatttatttgctgacacttctcatttcctttcagaacaaacctacattcccagacctataattttcttgagaaaatgggtttattataagtcactcaataaaacaccctaccatggcttcccagtacaaaa

SEQ ID NO: 411652 - DNA, 507 bp, Homo sapiens
gtaattagaagtcattagcagattgctctcagcaagtggaaagcagtgagaattctgaagcaagacttctctggacttcagggaagtccctctaaggaagtgacatctaaactggaactccactgcctctagtatgtctactctggagttcccacctttaagggtttctgggaacattaatatatatagtgtgagtggatttggccctctctgagtctgagagagtaggtgtgcaataagagttaacatttgctaacttgcagtcttatggctccttacagggctgagacttgaccttgtgactccagcctaggattatataaggatgtgactgaccttagaggatttcacgggaacttagctgtacacgtggaacccatttatttgctgacacttctcatttcctttcagaacaaacctacattcccagacctataattttcttgagaaaatgggtttattataagtcactcaataaaacaccctaccatggcttcccagtacaaa

SEQ ID NO: 411653 - DNA, 376 bp, Homo sapiens
aaggctatgacctgaaaatggcataatcacttttgctcacatcccattggtcggaattcaaacacagggccacacccagatacaagggaagctgggaaatgtagcttttcactgggtggccatgagcccacctacaactggagaattatttattatttaaggatgagggatattgatggacaattagcaacccgtgggaagaagctatgtcacagaatgactccccttgccatacgcattaagtatgtagtttatttaaaaaacaaaagattaactattgataacctaacaaagaaagaggttaagtcaggtggccaaagggtagaaaagacataaaatctggagatagcctgataataaagaatgctaattaata

SEQ ID NO: 411654 - DNA, 597 bp, Homo sapiens
gatgatcccttcttcccagaagaggccatgttttcccatatcacaacatgcatagaattggcactggtcaacactaaaccttctataagcatgatgaggacaacttctgagcagcatcatcaagcttgcctctcctgggccactacaacacctgcctcccaccttgacaagccctgcgtcaggcaggcatcatcccaatttggccttgcaagttgttacacgaacatccttcaagagtgatgcctgaaacaatcagttgcctttttgtctcgcaaaaagcctttgctctcatctcagcttagaatgtccatccatcacagttagcagggctgggccagcacggacctccagaatgtgcaatgagctttgtaggcaattaccactttctccaagggctctgtaggatgagggtgaagtgaatgtcattggaacggtagcattgtggtctaaaagctgcattctgccacagatcaacatgatgaaatgtttaatttagcctaaaattatttatctgtatcaccggccatgcctcaaccacatacccctcaatatgtaaacaacaatagatttatctgttttatttctgagaagataaga

SEQ ID NO: 411655 - DNA, 556 bp, Homo sapiens
agcctgtggtggtggagagtagccacccttacaccgacgacacctccaccagtggcacagtgaagataccaggtacgggggctggccccaggggggagctgcagcctttcccaccttcagaatgatgtgattctgtaattgcttcagtagaaacaaccgtctccattttataaaaaaaagttacagacttgctttagaatcatttttctccccttttccaacaaacttcttttgcacaataaatcatgacacagaaagtcacacaaagtaaatgtttagcttcatgataatcagacagatgccctagtcatcatgacccaggtctagacataacctgtggcagattctggaagccctcagcgtgtcccctgacgtccctctgagtgatgctctcctgatgttgagccatcactgacttgcatttctgggcagcttcttttacccatgtgtgtatctttcttttctttttcttttccttttctttttaacaactcaagaaaaattattaagaagaaaattgttgaggccccggcctttgatctggcaggcttcactg

SEQ ID NO: 411656 - DNA, 1096 bp, Homo sapiens
agcctgtggtggtggagagtagccacccttacaccgacgacacctccaccagtggcacagtgaagataccaggtgcagaaggactcagggtagaatttgaccggcagtgctccacagagaggcgccacgaccctctcacagtcatggacggcgtcaacaggatcgtctccgtgcggtcaggccgagagtggtccgactggtccagcgagctgcgcatcccaggggatgagttaaagtggaagttcatcagcgatgggtctgtgaatggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtggcctagccaccagtcacagaatgtgggcccttcagaaattgaggaagctgcttacaactgaatttgggcaatcaattaacataaataggctgcttggagaaaatgatggggaagcaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggtgcaaaagtcaaaat

SEQ ID NO: 411657 - DNA, 970 bp, Homo sapiens
gtttggctgtcgtgcatgcatggtgcaccgggcctggcggtcctggaacttctccagctcactggtgaccaaagcctgggcttgagccagaggcacatggcagcgctcgatgcactggtgcacctgcttcatggaggcctggctggggctggcgcttcaccgtctatcccatcatgccagctgctggccctaaagaactcctctctgaccgctgcgtcctctcctgtccatccatggacttggtgacgtgtctgttagacttccgactcaaccttgcctctaacagaagcatcgtccctcgccttgcggcctcgctggcagcttgtgcacagctgagtggcctagccaccagtcacagaatgtgggcccttcagaaattgaggaagctgcttacaactgaatttgggcaatcaattaacataaataggctgcttggagaaaatgatggggaagcaagagctttgagttttacaggtagtgctcttgctgctttggtgaaaggtcttccagaagctttgcaaaggcagtttgaatatgaagatcctattgtgaggggtggcaaacagctgctccacagcccattctttaaggtactggtagctcttgcttgtgacctggagctggacactctgccttgctgtgccgagacgcacaagtgggcctggttccggaggtactgcatggcctcccgtgttgctgtggcccttgacaaaagaacaccgttgccccgtctgtttcttgatgaggtggctaagaaaattcgtgaattaatggcagacagcgaaaacatggatgttctgcatgagagccatgacatttttaaaagagagcaagacgaacaacttgtgcagtggatgaacaggcgaccagatgactggactctctctgctggtggcagtggaacaatttatggatggggacataatcacaggggccagctcgggggcattgaaggtgcaaaagtcaaaat

SEQ ID NO: 411658 - DNA, 406 bp, Homo sapiens
tgttatagcctgcactgtctggtatagtagccactaggcacatgtggctattgagtacttgagaggtggctagtctaaattgagatgtgctgtaagcataaaattacactgggtttcaaagatttagtatgaataaaagaatgtaaaatttatcattaataattttttatattgattacatgttggaatattttggatatattgggctaaataaaacatagtaaaattaattttatctacttttttcttttttgtatgccaaataaaatatttaaaattatgcatgtgtttcacatttgtggcttgcattgtatttatattgaatagcattggtttgagcacttagatccagccatgcctaaagttatataactccgaactaataaaggccagtaaatacacattt

SEQ ID NO: 411659 - DNA, 678 bp, Homo sapiens
agttatttaatatagcagttcataatttaggccatggatcatctctgcagagaatcctaccatgctgcattcttgctttaaacctttcgccctctaaaacaatgcccaagagccaatgttagtcatggtcttcctgtatttgctctaggtaagctgtttcatagccttccaggacaacacttgcacaggttatctttaagcaccaacaaaagaaatggagaaatttgagccatgtatcctgagctctgaaaggcagcaatcatcttgaccccaagcatacaccatgttcagcttcctccccttggccaggtaccacagctacttctatcccagtgatcagcaggccctccagcatgaagacctttgagaaggatctatagctgtcaactcctaatatgatttgtgcactatcaccttgaagtaaaccagactagttattttcatgctaagagtctgaaaacagtgccttctttctgatgtctcttgtagaatattggcagagggatctcaatttttactttatacctgaagggcagctttttggtctgatagttatagtgcaatcattcatattttaaatcacaaatacccccacttgttgatgaaaactccagtctgtggcatgggtgtacattcactgcctaaaccatctttggccaaaatttgtgtgtatatgaa

SEQ ID NO: 411660 - DNA, 491 bp, Homo sapiens
agtggattcggctttctggaagacactgtgtgttgttgagcattaattactggacacttggaataatgtgttccgggaagtttcacagctatatttagtctggcggtttttcaagccaactgacatctccctgagcctcaaaggagaagaattgagtgtcaggccccatcctggcgctcgatctgcacccaaggccagcgccagcgtcccggggcagggccctcctgctagagacctggtgtgtactcggttttcctgtctgtgatgctcatgtcaacctgttggttccaactgcaacccaccagcgcccccagcattcctgcacccaggaggccggtatctgaggctctgcagacttcccagggcctctgtcaggggtgctgtgtgtcctgtcccagggcccaggtcgaggtctaaccattttaaatctccatctgaacagcactcacaggggacaggagccctcagtaaactcctgtcgcaaacgaaaa

SEQ ID NO: 411661 - DNA, 412 bp, Homo sapiens
cagagcccctactgtgtgcaaagaaatgaactgagctctctggcctcacaccctaagcccaaccctgatccactaagcactggcagcttcaggcccaccactgctggcctcccatctctttctccaagcaacggtgcctgtgtgttgagcacttccagacaaacacgcctgccatgatggaccacatttctgtgcagatgctgagtacacaccgtctcccactcccacggctgctttgcaaggacagtgttaatgatcctcactttgtaaacaaggaaaactgaagctcagaaaggagggatggagggcggtaaggttgggcatcctacacatatggtgatatcattgaacattttgtgttgaagaatgatggagtgttgaacacagaatcagagaattttactttatttta

SEQ ID NO: 411662 - DNA, 371 bp, Homo sapiens
agagccaagattgcataagaggattgcattttggatgtttttaggatgtgagctgaggtaggcttagctctggctcaaggatttcaaagtaactgacttgttttgtgtactttcagctctctgcaactcttgctgaattttggcatctttagcagagcaggagcaatcggcattgataaacagatttcctcttgtatgggtgccttgccagtgcagggatgtgcagtgatctttcaccctctcagctttcctctcgatactgcattcatcatttcaagagctttcaggaatgtgggccgtgctgacattttgtaatgtctatcaggaattgagattttagggtaacaacataaaatgttcctaaggtgaaa

SEQ ID NO: 411663 - DNA, 472 bp, Homo sapiens
tcatggccagagaactggtcctgcgtgaagaatgcacggtttaatttgaggaacatttccaacgggtcttaaattctggcctttgctgttactgtctacaaatgggaagaaaagtggtaggcaaatttaaaaaccaaagaggatttaataattataattaataattgaaaaaaagacaaactaagactcaaaacattgatgggaatttataaaattggattggatgatgtttgtagagctctgtaaatttattaaaaattgtatttatgaattcaaaatttaaaattataaatatataaatatgtaaataaaaatgattttaaaaattaactgataatagctctttacaatttttaaaatccctccgaatatagaatagcataggaaaatgctcatgttagtgatacaaggaagatagcaaagcagaactatgcagtacaatcttgattttgatgatatttgtatattaaaa

SEQ ID NO: 411664 - DNA, 408 bp, Homo sapiens
cacttaaatctgagtgtggaaagaagcatctcaaactgaaacttgctctgacttcactaaagttctttcaggaccctgtattattgccccattttacagatagtgaaattgaagtacagagagtttgaatgtggactcacagctagaggtggcaaagccagaactgaaactcagtcctgtccatctccaaactccatgcctttcccacacccaagcacagtctctttcaagttttagttcttttgcatgcattgctgaatttgtacagttagtgtaacagttattttttgtcattgttttctttggcctttgcctttttataacttgtgctgtttactcaaatatctgtattttgagctgtggtagctgaatccctggaaataaatgttaatcaggtcttctcagatc

SEQ ID NO: 411665 - DNA, 351 bp, Homo sapiens
tgtctcccgggtttaagcgactttcctgtctcagcctcccaagtagctgaaacgacaggcgcctgccaccatacccggctaatttttgtatttttagtagagatagggtttcaccttgttaggctggtcttgaactcctgacctcatgatccacctcactcggcctcccaaagtgctgggattacaggcgtgagccacagcgcccggctggctgttgcttcttaacacctttattacttttgtaatcatgggtatgagttgattttctggtcagaaatttcagtagagctaatttcatttaaatgtgtgagatgtggtaaagttttgacaataaatacaaattttgacaaa

SEQ ID NO: 411666 - DNA, 379 bp, Homo sapiens
ccctcccctctctggaactcagctttcctatctaaaatgccgcaaataatcctggctggctgcctccccctctctattccttttgcctcctaaaaaggttagaacaactgacctagtgaaagtcttgaagggaaattatctctccgttatttgatggtatttctctaggcttttccaggaggtcagcaagaattgggaactttcaagggcagggaccgaaaggggacagaacagtgtagccacatgaatggcagtggccttcaccttttttgtcctcagcacccagtacgtggccatttacagagtaatcctcagtgaatgtttgttgagtgaatcagtgagtgaataaatgaagggatgtggcacccccgggtttaca

SEQ ID NO: 411667 - DNA, 355 bp, Homo sapiens
tcctcttagggccaggtcccaggagatacacacatcatttcttattcacatctcattggccacaactgagtcaaatgatcacattggatctgagctccaatggaggctcagaaatatctatttttgagagatgccagacaaagcactgtacattctattcaagtgagaagaaaagaatagctataagggaaaatctcatctctgttacaattgtacaccagtgtcaagtacatggttaatgtatatatgctgaattaattattagaccactgctaaaattatgtttaacatttgatattaaaatagtattttctgtcttaaacaaataaaaacctgcattaccatctaacaggaa

SEQ ID NO: 411668 - DNA, 691 bp, Homo sapiens
cttacaattagaaaaaaaaattaaccagagatattgtacaaaatatttattttttgacagttttgaataagccatataaagtattatatatccctaatgaagcttaatggatagtattccaggtgttggtggtgtctgtatctcaaagaaagaaaaaaataacatcacactaaacagatttaatgcctctgttttcaacctaatggaacaatagttatcatttcaattagagtcgctttgcaagtttatgtgaatctttgctttgtaaaaacacatacaaaacacaagggaaaattctcattttccagcaaatacagcaacttctaatatgctgtttctaataatgagtcaccatcaaataagtaataaatatttttttcaaaaacaagagctttctgttttattattgattgacagatatttaccagtttaaggatattggtcataagcatctatataataaaccctttatattagatgttaaattaaaatttttcatagcatgaatagatttttaagtgaccactcaaaaacatagcaatttttgtaaatatactgtatgtgtgtgtatatatatatatatatatatatatttttttttttgatgctttgatctggaagaaagaaatatcaagagtttctattcacaacataaagaaaataaaatgtttttagatatttttaactcttt

SEQ ID NO: 411669 - DNA, 611 bp, Homo sapiens
agtgactacctatcttcaaggggctaccaatatcttttttatagttgcaggaggacagtggcctgtgccacttctggagactatggccaaggaatccacaggttgaaaatagtaccacataattcagccaggcttaaaggtgactgaacaatctgagggcatacaggcgtagaatcaacttgtacgctgtgtatacaaagttaagaagctcagggaattataagtataaataagcaggcacagtgatatcctataagaagggtccatcatttagttatctaaagtgtaaaattattttaattgctaaaggacttcatttttcacaaaaaggccttcttataatacagactcaagaaaggtagaagtattgtcaggaattttaaaaatgtttcaaaatacaaataaaatcccattaaaataaactctgtaatagccattcattgaaaagttgcgataaaattttttatggtatttgtgaccttaagcaagtcaaatcctcttttggtctcagttttcccatctataaaatgaaaatcactaagagttcacccacctttctaactctactccataaatacagcaagaaaaatcatttaaactcaacaacccaa

SEQ ID NO: 411670 - DNA, 405 bp, Homo sapiens
aagaaatgtgaccgttgactctagtgcctggaaggaactgtgccatttgtatagaagaaggtgctgtgcattaggattgggagttctgatgaaggatctactacaggagctgtccagttacaacggagaggaggaggacccagaggatgtgaagaaatcctcaggagttatacaaaaggacactctgatgcttgcttcacagaattggaagactccaccattacaggtggccaccagcagatgtcagcaagtccttcctctgcacctgcagaagaagcaacagaaaagacaaaagtggaagcggaagtgtgaggggaagtggaagcaggcagaatgatgagggaagcacagacgtgcccatgttcttcatggctacactcacattcttgttgtcccatcaggaaa

SEQ ID NO: 411671 - DNA, 592 bp, Homo sapiens
gaattgatggtggtcattgtggctagttccccaacattcctttcaccccagatgggtcatttagccagccacaagaatctcattttccttctcagggccctatgtaggaatggacatgcatgacccaattctatttaatgtatttatatgtatattagagacagagtctcactatgttgcccaagctcatgatccaattctagccatgaagcctgagtgaaaatctaatggcgtttctggaaaaactttcctatttctaacagtcagagaagaaaaaggcccctattttctccttcagatattgtggcatccgaattttttttttttcgagacggagtctcgctctgttgcccaggctggagtgtagtgtgtgatcttggctcactgcaacctctgcttcctgggctcaagaggtcctcccacctcggtctcccagctgcttgggaggctgaagtgggaggatcacttgagcatggaggggggtggaggctgcagtgagctgtgattgtgccactgcactccagcctagatgacagagtgaggccctgtctcaaaaaataaataaataaatttagatacacagaaagagagc

SEQ ID NO: 411672 - DNA, 186 bp, Homo sapiens
caattatgcagctacagccaaaaccaagttctttttattgcaatggtaatgaaaggagccccgtgtaagtcactggaaggtcacatgttcacagactgtcagctgtggagggttatgtaacagtggttatgcaatgccacgttagaactacagcccgagcagcaaaacatttagataattttattg

SEQ ID NO: 411673 - DNA, 1191 bp, Homo sapiens
caggagttcaaggccagcctgggcaatatactatagcaagcccctgtctctacaaagaacagaaaaattagctgagcatggtggcatgtgcctgtagtcccagctgctcggggggctgaggtgggaggatcactcaagcccaggagttcaaggctgcagtgagctatgatagcgtcactgtactccagtatggacaacagagcaagaccctgtctcttaaaataataatattcaaccaatgggacacttttcatttattcaccagtgagcttttggccctggccacgtgccaggcagtgttcggggtgcttgggatacgtcagtgaacaaaccagacaatggctccctgccgttgtgcagctgacattgtaatgtgtgtctgtgtaggtgtgaatatattgcccgttttggggggggtgcggcataaaataaatggtcataatttgtgtagaggtctatattatgggaaccagcctcactgagatactagcatttgggccaagacctgtaggtagagagggagcatgctaactcctatggtgagcctggcagggacgtgctgtggtccagaacttcaaggtcttcaagctatttttgcacacccataagcataagcccagaatatattcagtcccagttcctacttcgctcgtggtcctctaaagcactgtcttcagcctcaaacctgtcatgcagggacagaccctgggaagcatgtcctttccatgcagtgaaaaatactccatgcagtgaaaaacacactccaggcataatgcgtatcagcaggggcaaactaacagaaaatgagttgttccagaaggaacaaaacatacttcatgatgaaggcaaattgtttttcacacttagctaaatagaatttgggatgtggggtgccatgtgcaattaatgaagtaggctttctcaaatgaaaatatgccaccctgggcaacataatgagaccctgtctcaaaaacaaaaaaaacaaaaaaaaaaaaacagaaaaaatcatccaggtgtggggcacatatctgtagtcccagccattcagaaggctgaggtgggagggtcgcttgatcccaggagttcaaggctaaagtgagctaggatcacaacactgcactccagccttccagtttaggtgacagagtgagactctgtttctaaaaaagaaaagaaaatacggtccaccaa

SEQ ID NO: 411674 - DNA, 1245 bp, Homo sapiens
caggagttcaaggccagcctgggcaatatactatagcaagcccctgtctctacaaagaacagaaaaattagctgagcatggtggcatgtgcctgtagtcccagctgctcggggggctgaggtgggaggatcactcaagcccaggagttcaaggctgcagtgagctatgatagcgtcactgtactccagtatggacaacagagcaagaccctgtctcttaaaataataatattcaaccaatgggacacttttcatttattcaccagtgagcttttggccctggccacgtgccaggcagtgttcggggtgcttgggatacgtcagtgaacaaaccagacaatggctccctgccgttgtgcagctgacattgtaatgtgtgtctgtgtaggtgtgaatatattgcccgttttggggggggtgcggcataaaataaatggtcataatttgtgtagaggtctatattatgggaacaaaatagatagtagtgtcaggggcttgggacatatacagaatgaagtaagatgtcagcctcactgagatactagcatttgggccaagacctgtaggtagagagggagcatgctaactcctatggtgagcctggcagggacgtgctgtggtccagaacttcaaggtcttcaagctatttttgcacacccataagcataagcccagaatatattcagtcccagttcctacttcgctcgtggtcctctaaagcactgtcttcagcctcaaacctgtcatgcagggacagaccctgggaagcatgtcctttccatgcagtgaaaaatactccatgcagtgaaaaacacactccaggcataatgcgtatcagcaggggcaaactaacagaaaatgagttgttccagaaggaacaaaacatacttcatgatgaaggcaaattgtttttcacacttagctaaatagaatttgggatgtggggtgccatgtgcaattaatgaagtaggctttctcaaatgaaaatatgccaccctgggcaacataatgagaccctgtctcaaaaacaaaaaaaacaaaaaaaaaaaaacagaaaaaatcatccaggtgtggggcacatatctgtagtcccagccattcagaaggctgaggtgggagggtcgcttgatcccaggagttcaaggctaaagtgagctaggatcacaacactgcactccagccttccagtttaggtgacagagtgagactctgtttctaaaaaagaaaagaaaatacggtccaccaa

SEQ ID NO: 411675 - DNA, 369 bp, Homo sapiens
tttttcgcctaccatccttagattcacatatgatccaagcaataaagccctatttgcaaatgggaaactttttaatcagaggatgagggtgacctgtccaaggccacatagcaaaatgtatcctcagccatgccagggtccaaccaacattgagaagctagaccccaactcacacaggcactgaggaaattggggaagttctccttcatcatcgtcagcaggcttggcttctcaatcttgccatcacgtccggtgtatttgtgaaacatgtcgatcatgcctattatggacctctcagcttgagtgttgctcatctttgctttcaaaaagccttcaggaaataaagacaatcatttcttaccttagttt

SEQ ID NO: 411676 - DNA, 470 bp, Homo sapiens
ttaggtatttggcagttaactcatctggatatatgggaacagaagtgccagacacgtagataatatttggagaacaggagcagacttggaacatgctgaatagaggacaaggaaatgagaagaatgtatattctgtgattgttggatgaagtgatctgtagatgtctatcaggtccaactgggtatcatcagacaaacttaaagatgatctgacaatgtcattttccaagggactgatagaaagattgagtatcatggaatcagaacagacaacagagaatcagatttggactgaatcagaataaacaggcaatgcagacacttgttctctgaatcacaatcaagactcagtgctggaacagatttgagattctgctaccccactcccatctatgctggtctgctgaaaaaacaaaacacgcttgaaatagcatatagaaaataaaatttgcaacttgtagtcacaaaaa

SEQ ID NO: 411677 - DNA, 385 bp, Homo sapiens
ttaggtatttggcagttaactcatctggatatatgggaacagaagtgccagacacgtagataatatttggagaacaggagcagacttggaacatgctgaatagaggacaaggaaatgagaagaatgtatattctgtgattgttggatgaagtgatctgtagatgtctatcaggtccaactgggtatcatcagacaaacttaaagatgatctgacaatgtcattttccaagggactgatagaaagattgagtatcatggaatcagaacagacaacagagaatcagattctgctaccccactcccatctatgctggtctgctgaaaaaacaaaacacgcttgaaatagcatatagaaaataaaatttgcaacttgtagtcacaaaaa

SEQ ID NO: 411678 - DNA, 256 bp, Homo sapiens
tgtctagttagaatatatgatccaggtaacccaacctatggccacatttctttttggttattaaagtaaaagcacacatgcgaacttatttagatacccaaagatatggcaggcatctttgaactaacgcacagacttgttctctttgtttgaaattgattcaaatgagtcatatgatctgtacaaatgctcttcctgttctagagtaagacatgctaaatgtttaataaatgagtgtgtgcttcccagtgtggca

SEQ ID NO: 411679 - DNA, 336 bp, Homo sapiens
aggtaaatcagaatttacctgggattggttggaggggaatggggtgttaatgctcactggccatggagcttcagttcagagttataaaaacattttggaaatagtggtaatggtagcacaacactgtgagtggaattaatggcattgaattgtatacttgaaatggttaaaatggcaaattttatgtgatatataccactgttttaaaaattaaaaattaataaaagtaacattactgaaaaccattgaattgtgtactttaagtttgtgaattgtatggcatgtgatttatagctccataaagctgttaaaaataaaaatacaaaatattcacct

SEQ ID NO: 411680 - DNA, 395 bp, Homo sapiens
ttagtgagcttaggccctggagtgagcaaaagatgaaaaacatgaatctcttcttcactcaacttctatctgtgattctagaaagattctggttatattcagccttatttttctaaaatgtggcccccaaatgcaagacaagtatttcaccagactcacctgaagaaacagtgagctcttgcagtgctagagagaaaactagttagagtagtctgtgctgagccttgtaatgttacagtctaaagaattagggaagatttttctgggagggcaatggtcagaataggtatattggagaaaacttcatctttgctgctgcttttaaaggaatgttttcttaatgctcttgctccaatttaaaagggcataaataaattatatgaaaacttttgaaa

SEQ ID NO: 411681 - DNA, 452 bp, Homo sapiens
aaagggggaggtttccttcctgccatatcatgacttccgagacctttcctgaaaagaaacagtgaaaaccatcttcccctctacctactgtgtcctggaggaggtaaagtgtcttatctgtatgagtgtggaagaagatattaggtgtgtataaacaattcatttctttctccttacttttgcaagtgaactgtctgcaagaagtgtatattctgttgcacccatcatgatgtacaactgccatatgtggaatcctaccagtcaagttgtgctgtgtacaattctgctatttctgaggcttagtattaagatgttatcatcccaaatataacacacttctgctaataacagtttggtcagtagtaaaggaattatttttgccttctgccttatgtgctttatttctttgtcttataattcttgtcaatttaaagattttaatttatcagaca

SEQ ID NO: 411682 - DNA, 476 bp, Homo sapiens
aagtgatgatctttcacacctagtgcccagatcttagtttctaaatatcattccccactggtattcagggttccttggagaaatgcctgatcccagaaccagggcagggaaagatgcctggaaaaatgagccttgaatattttattgcataagaaaataaggaactggtcaaagaaccatggggagaggtcaaaaatggagctggaagaggctcttactggccaaatctgggacaatttgagcatcaaaataaatgatagtactagtttgtcacccatcgaataaatattcatgagtccatgcagtataaataagtaaacagaggagaaagtgaaaagtcttctttgcagaagaatgccaactaataaataagaaggaatagtagcattaaaagatcatccatggtagaggaagactgataagaagtggtttatgtagtctcagattgtctccccacaaattactgattaattaaa

SEQ ID NO: 411683 - DNA, 479 bp, Homo sapiens
agcttgtctgtccacacctctgacagcagtgatgggatgaggagaaagcaggagcagggagcagaggatgatcaatgggatcccaggagtcagtctcacttttggagcaaagaatccccagccatctgacagctgagctggtcctgataactaacctgttgcctgattccaagcagaacagcctctccaggtgcaggtggcagaaggcacagacaaagccatcacctccctcaaaacaaaaataaaacaaaaagccctccagcaaaaagcccagagaggcagcttaggagagggcaaatgagactggtctggagtttgagagaactggaatctagtccctaatcaatcatgaacgtgctatgtgcatattgcctctctaggactccatctctataaactgagagggctgaactacagttcctgtagtaccctccagtgatatgattccatttcataaaaagctgtgagccatctaaaga

SEQ ID NO: 411684 - DNA, 526 bp, Homo sapiens
tgttgtgactctttcagatgtatgttttcttttaaatgaatcatctttaaatatatgcattgtctgagcaagttcaggattgtaaagtgtacatttaattgtaacagaacagaacagcagtgggcgtctgtgctacagatgatattcttagggtatttgctgccatccactctcctttctaaatttggtgttacagattcaacttctgtttttaaaagggaagttgcagatagatcattcacactattattttctccttaaagctagcttctctgcccatgtgaggagtttcctataacctaaacaagacttctccaagaaaaccgctttgaaacaaatattacttagcaagattaaatcttttgttcaatatttaaagtatatttttgaaaaaacaattgactacttatacaagtgtacctaatgtggtgttggtgtctgagctgcttgctttattttcttcctacttgactttactctgcatttctgaaattttagatataaaaatttaaaaactaaaaacaaa

SEQ ID NO: 411685 - DNA, 503 bp, Homo sapiens
atagaaactaacattctgagattaggaaatatgttgatttgaaagtgagaaaatacttgcctaaattttgttccttcttttttttcccctctgatacttggatacttgggctgtttattggggtccctttctctccagcccatttattggagcagggctttgcaaagccggtctcctagcagccaaatgcagaaggcccattcatattacaatggaaggaaaggaaagaaagagcttggtttgtttaaactgcctctgtcttcattcacagcctgatgtccatgtgcattgtgagtccacaatggcactaaaggactcattgtggccgaaaacaaatcaaaataaaataagggatgctaagataaaagagtcatgcaacaaaattgcttaaaaaatctaagtcttacatctgagatttatgttaccttttggctgtgtggcctattgaccggtatttataacaaccgctagagtttaataaacaaaaagataaatgggaaaaa

SEQ ID NO: 411686 - DNA, 506 bp, Homo sapiens
ataattcatgataatttcaaaaatttgagtgttaatcacttaaaaatgtcctactgtgcatattcaagagctgtgcacattcattaaaaactgtgaacatttctgcggtccagactttctggggagatggtcacgggtaggtcaccccacgccagtgctcacctgctgaggggtcattcgttcagctctttgctaaggtactggaaaggactaataaatatgttgaattcagaaacatatgctattcaggaaatcagtagtaaacttggagaattaaatagacccattcataattaaagagctgaattactgtactaatgaatttccttcccggaaagtgaaatctgatggtctcatccatctgttccttctcccctcactttatctctgttacttttctttttctttctttctttttttttttaatatacagtgttactgttttcttaaatcgaggttactccagctcattctccttcatactttttgattgttctcacattaaa

SEQ ID NO: 411687 - DNA, 400 bp, Homo sapiens
acagactccacttgtaagctgagagctttcaatcagccattcagtcccacatctgtaaatgtgatggaacaacaaagaatgtcagataactagtaatctaatggacctgaactcttgaaagataaagactaaagcaaacacaagaaggtgacatggaggaccagactatacagggcaaggtctgcttctagaattcctaatagtacatgggggttcattaacctttttctctcctcttgtgaatgtttaaaaatttccattataatttaaaaaacttattataaacataagatattgtagcaataatacaataatagcatactataaaaaagactgagaacaataggagctctttaaaaattaaaaagacctgagtgtgagcaatttattcatttataaa

SEQ ID NO: 411688 - DNA, 469 bp, Homo sapiens
taggcatcatttgtataacccaaactggaggagttctgtgattctttatatgttattttcgatggtggtagggaggggcagattagcttcctgaatatgctgtgtcatggtgtgtggagccatcttggactgtagctttgtatctgtcactggaagaaactgcagagaagtaattatatttaagcagaagaattttagcctgaggtttcttactgagtaattcgtagtcatttataattaaacaaaaaagtataccaaatagcggatggcttaggctttctggtagggagttaggtgcctttctaactccttgtccctgcaactgccctaatggagagttcagaagcaggaaagaacaaacttctttttcattctggatagagaggagatgtcattagtatcaaagttaaattgaaaaaaggccagtacactcaagcctgggcaacagagcgagaccctgtctcttaaa

SEQ ID NO: 411689 - DNA, 335 bp, Homo sapiens
aatcatacaaggcattaaggccagcccacattcaaagggaagaaagtcagacacttctcttttctatgggaatgtcacagaatctgtggccatcttgaacctgcctcagaggccatgacatcacgaattctgttaaagacatgaccatctcatttcctgccaggtctggaccctcaattccttcacttgaatgtgagtcagcctcatgaggacagttgcatttgcctcccgcctattctcatgcctatgatcactcctttcacaactattaactcatctcacacagcctctctgcatagtacaattctgaaataaaatttgattgtgttaaaaaa

SEQ ID NO: 411690 - DNA, 1300 bp, Homo sapiens
acagtaaaacctgtattttaccttttaagtaagaggaaatatgatattcttattcaaacttaagtttagaatccagaatattactgtcgcactttttggtatcctgagtttccatagggaactattgggtttaaagtcaccgttggaactacactgtgtgatcttataaacttatgttccctggctatcatattcttggctcagaacaatatttcccattactatcttaagaattaaggcattcatggctcacgcctgtaatcccggcactttgggaggccaaggcaggtggatcacgaggtcagagttcaagaccagcctgaccaagttggtgaaaccccatcgctactaaaaatacaaatattaggcgggtgtggtggcgggtgcctataatcccaactactcgggagactgaggcaaagaatcgcttgaacccggtgggcggaggttgcagtgagccaagattgcaccactgcactccagcctgggtgacagagcaagattccatctcaaaaaaaaaaaaaaaaaaaaaaaaaaagaattaaagcattcatacagtttagtgattttgtttagtagtcggctatcaattgctatcaaatataacactgctgaaatcagcagtgtgacttaccttgccattgttaaaatgttacataaaacataacatgatagatgctaaggcctttttttgctataattcaccaatagcaatcaagcatgctaacccatactgaatgatatttacttgtagatatttcttcctttccttgaaattctcctttctatggaaagaagatgaacccaaaaaagtgataggaaatgtggaatgctcatgcagatttagctctgaaggcatatttaataactagtatgtcttgacaacagtctttagattaaaaagaattttcatggaaacatttaacagaaagaactagtaaaaagacactttgagttagtccaggcttaatgtgcaatactgactctatactgatcataatttatttatgcgatcatattaatagacctaatttcattaaaacaggtagaagatttttcaaaagaaagatgatgtttcaaagctggtctgccattctagatgagcctccttgcttatttaagttccagtaggtgttcaaatgttaaatgttaaacataggtcatctttgcttctgcagggcttcatcttgcatgtttaagagaactttgttttattttgagggattatttctctggggatcattcttataatacaagccttaaatcactaattttagtagcaataaatgttaaaattgaa

SEQ ID NO: 411691 - DNA, 503 bp, Homo sapiens
acttcagagtgatcaccgcccggccacgcacagcctggaggagcccatgtcctattagggtatcggctttgcctccgattatctggcaaataaaccaatttaggagtccgccagggtctttctggccacctctccagggccctggctgggccagtcctgtcttcatttccatacagccagcatcctcagtgagatggagaaatgtcattatttaccaagaaaccaagatctgaaaatggcaattactcggcaggtcagcagaaagccccaggatacttctctccccgggattcagccagcagctcggagctggaagaccgagccagtgcccaccccacaggctcccaccccctgtgaactcacatcccattggtttacaaaaacgactatgtatccccccgacaaatacgtattcatgcctccaaatgttaagtctattgcacactttataaaacacaaactgaaaagtcacagtaaaatgcagatataaacatgaaaagatt

SEQ ID NO: 411692 - DNA, 396 bp, Homo sapiens
agagtgttgccagtaatcaaacctattgcatgtcagctgctttccagcatcattcttttctatcttacagcatgacactttctggattgcagtgaaataaagaaacagcaacatgcatgcttgcttgaaggaagtgtgatgaggcattcctgatttggcaggggcaattcatgaacacgctttagaaataagggattttattggaaagctatgaggcaacagtgcatcctagtggatacagttttgctctaaaaataaaaaatacattttatttccctacctagatggctaacatcatgagaaattttgaaaatggcatttttagtccatggtttctggttttgcctgaagggttcaaatcctcctctcaaaataaatcaaagctattatgtgaga

SEQ ID NO: 411693 - DNA, 898 bp, Homo sapiens
tctttgcgcaggggccatactaatcttctctgtatcattccaattttagtatacgtgctgccgaagcgagcactttgcggacattttaatagtcaccggggatgcaagcatcagggaagaatacctcagagcacgggccaagctgtctgcaactcagtgggaagttgaacaaaccaaactttacaaagggaggaagaacgaggtgccccaaattatggagacacagggactggttaccaagaccatggaccggaacaagaacctcgctccccattaaccaaccgcatggccttggtgtgcctagatttcctcttttgtaaagtgaggctgaagtgtctccctttggatggtaggcgaggaccaagaggcccagcgcctggcggtgacatgatacagcttctgatagagaaggacaggtcctggtcctcctgtcctctggcctgaggggctgaaggtgacttgaggtcccaagaccgtggagctgggacataggttggcacccctgcactgttgagagtacaagaaccccatgagagccgctctcagccacagactcatccctgtaccttccacggggtgtacgccgggcgtgagtgcaccaaagttgcatccctcccctggtgttggtgaccggcccaagcccctgatttccctaaagaccgaagtctaatgcctgagatggatcctaacgttacaggcactggctgcagcaagcctctgactctggggcgaatcctctggggcctcatcacaccctcccctccccaaagtcaaggaagccacacctcctgggccgactgtgaggctcagttatctttataggaaatcctgacgctttcctgcaaaaccctgtggttggaataaaagatgccccagaattttgttatgccaagcaagg

SEQ ID NO: 411694 - DNA, 1013 bp, Homo sapiens
tctttgcgcaggggccatactaatcttctctgtatcattccaattttagtatacgtgctgccgaagcgagcactttgcggacattttaatagtcaccggggatgcaagcatcaggtgacaaggagcgcagaccaacaagctgtcaggagggtggcttcctggtaggaggcagcacaggggagcccttttcaacgatattttatttccatcccgttggcattgcccacagggaagaatacctcagagcacgggccaagctgtctgcaactcagtgggaagttgaacaaaccaaactttacaaagggaggaagaacgaggtgccccaaattatggagacacagggactggttaccaagaccatggaccggaacaagaacctcgctccccattaaccaaccgcatggccttggtgtgcctagatttcctcttttgtaaagtgaggctgaagtgtctccctttggatggtaggcgaggaccaagaggcccagcgcctggcggtgacatgatacagcttctgatagagaaggacaggtcctggtcctcctgtcctctggcctgaggggctgaaggtgacttgaggtcccaagaccgtggagctgggacataggttggcacccctgcactgttgagagtacaagaaccccatgagagccgctctcagccacagactcatccctgtaccttccacggggtgtacgccgggcgtgagtgcaccaaagttgcatccctcccctggtgttggtgaccggcccaagcccctgatttccctaaagaccgaagtctaatgcctgagatggatcctaacgttacaggcactggctgcagcaagcctctgactctggggcgaatcctctggggcctcatcacaccctcccctccccaaagtcaaggaagccacacctcctgggccgactgtgaggctcagttatctttataggaaatcctgacgctttcctgcaaaaccctgtggttggaataaaagatgccccagaattttgttatgccaagcaagg

SEQ ID NO: 411695 - DNA, 460 bp, Homo sapiens
agcaaatctcactggtgcccgtggtctaccacagtgctcccctggtgccaccatcagagacagaccactgtaaaacctcatggccccttgttttgcagcgtgcaaggccaggcttatgaatagatatcatcatctgccacccatgtaatgtgatctgagaggcatcactttgtacggaagttttaaaagatccctctggcaggcgctaaagtagggttattacaaaggaaggcaagagatggtagtgtctgtccagggaggcagggggaaaagtgttgaatttgggttctgtatttgaagggagagaatcagctggtgcattggatgtgtgaagtaaaggatgacttcagagcttttggcctgagcaactagaagaatgttattgccatttatttgggaagagaggagacttgggaaaagcatgtttcaccatttggctcaagaatgatacacattaaaa

SEQ ID NO: 411696 - DNA, 366 bp, Homo sapiens
gaaggctgtccctgaattcctccttcctgtctgtttattggtgatggggcagggggtggtcaggggtcccaagcctcccgggcgaaggccaaagccctgctttctttaccaagttcctcagaggtctccactcgcaaatcattggcctcatcgggttggcactcgtccacttgcatttctagctgggacattctcttctctgaaaatagtctgtggatagaatgaacggacaaaggaatttgtttctgttaaggtgttgcttatggtagggcaacggttctgactcttattgttcagtcagattccttcatttcccaaactgctctggatttcgccttatcttggaaatcagaacctagtttgact

SEQ ID NO: 411697 - DNA, 470 bp, Homo sapiens
caattaggctaaggaaggttatgggtaaagtatgtttagggagacaattagacattcggttttctagctcacctcttcaccagtgatgaagccttcagggtgccatctttattcaggcagtcccatttccagcttcctatatggcatgaactgacgtcttatttctcatacttatgtggacatttaaccttcaaaagtaacaatccgctcacataccttctcctagtccctagaagacatagccagttcacacgctgaccactcaggttttcagttcctcctttatgttcagctcctgacagttccctttcttgcttgcaaatcttactttgtacagtcgtcccttggtatacatgtgggattggctccagggccccttccatatgccaaaatccacacataagtcctgcactcagtcctgcggaacctgcactccagcctgggggacagagtgagactccgtctcaaaa

SEQ ID NO: 411698 - DNA, 454 bp, Homo sapiens
aaaagtaagaattgccaaaacatttatatgaccttttaagacaatcaggactcagttccacttcatctgacatacgactagatggcacaactttcagaaaattgaatcactttaaagacatttgaaatgaaggcaatggaaggacgaggaagtgaattgaggaaaggagtattttctagatgtcctgagtcacaacttcaggacaaagacagctacccatggctgtggaggaaatcgtgctggcatatagcagagtatgtgaaagcggcaagattcagttagcaaacatgtacaattcacaggcaaactgcaagagtaattacacctcctgagcaaggggaaggaagtgtggaaacacctgcaggtcatgagatgttacatttcaggatcattggtccatagatacgttcatcaatgtcgcctatcatcataaagtattaaagcaaatgtaccc

SEQ ID NO: 411699 - DNA, 261 bp, Homo sapiens
acacaatcttatacttcattaccagagccactggatcaaatttttctcctattaatttcctcccaaatacaagctttcctaattcattgagcatattcttttccctcatgatgccaaataccatgcacatgcttgaacacaactatcaaagctccactagctactgaggaacatataaggtggttccgttttttagctttgtcattgctgtgtcttcaacctctcaataatctccaaataaatctcacgttcttgaatccc

SEQ ID NO: 411700 - DNA, 510 bp, Homo sapiens
catcccatactcatgactggaagaattaagatagttaagaagcccacactggtctatagcaatctaaagatttaatgtaatccatatgaaaataccaatgtcagtcttcacagaattgtaaaaaacaattataaaattcatatggatccaaaaagaacctgaatagccaaagctatccggagaaaaaagaacaaagctggtggtatcactttacctgacttcaaagtatattacaaggctataataaccaaaacagcatgatattggtatagaaatagatacatagaccaatggaatataacccagaaataaggccacatgtatacagccaattgattgtcaacaaaactgacaagaacttatattgaggaaaggacaccttcttcaataaatggtgctgggaaaattgtatacccacacacaaaagaatgaaactggattcttctctctcaccatattaaaaaaaaactcaaaatgaatcatacacttaaatgtaagacccaaaactat

SEQ ID NO: 411701 - DNA, 359 bp, Homo sapiens
ttatggtaaattgattacattcatagccccaattggtggtctctctgtacccatgatttttgcaatatgacattgtaatttgtcaagcaatggagtatatttccccagcccttgaatctgggttggtattgttttttatcttgactaatgtagtgcagtggaaatgacattgagccacttatgaatctatgcctcaagaagtctttcatgctcctgttctctctcgtggacctctctcaaatggatgatgtgataaaaacaaacccaggctggcctaatgaaggacaagagaccatgtggaggaatgacaagttgtcccagcctgagcaacagagcaaggcccagtcttgaaaaataaa

SEQ ID NO: 411702 - DNA, 366 bp, Homo sapiens
ggctcccaccccccctcagacagcatccggaggtgcctgagccaaggggccgtgctccaacaacatcatgtgaagttggagacaaagcccaagaagtttgaggaccgagtgctggccctgacctcctggcgcctccacctcttcctccttaaagtcccggccaaggtggagagctccttcaatgtcctggagatccgtgccttcaacacgctcagtcagaatcagatcctggtggagacggagcgtggcatggtgagcatgcgactgccatcagctgaaagtgtggaccaggtgacacgacatgtgagctctgccctgtccaaggtctgccctggccctgggtgtttgatccggcgtggaaacgca

SEQ ID NO: 411703 - DNA, 819 bp, Homo sapiens
gacctaactcaggaagaaacatacacttcctacattttatcccataagcaaagcaacttctgtagaactgcccatggagattttgtcttaacttcaaaaagtgcttctcctaatttattttctgttgcacggtatcaagaagcacctgtggaaaaaaaggattcaaaagaagaaaaccataaccatcttacaagtttttgcattgctgaagactgacgacttcacccagacccaccaactggtcctgggacccccacccaggaacccattcagtgcaggaggacagcttcagctccctgtgtcttcacgtgtgacccaattgatcagcacttccctcttcctggccccctactgaccaaactatcctttaaaaaccctagtcactgagtttccagggagactaatttgactaataataaaactggtctcccattcagccagctctgcatgaattaaactttctctattgcattcccctgtcttaacaaatcagctgtacctgggcactgggcaaaatgaacccattggatggctacatatgtccaggttaatcccgtcatcactgggggacttgtgtaggggattttggctctggaaaggatggattagagatctgtgttctccagactgaagtgtgcagattattgccaagaaaaacctctgagaagcacaagctcaggccttggggacttcacgcatgttggttgcctgctgaataggaggctcctgtgtccaccctcacagcttggtcctcacttatatgagcccaactgggaatgctctctgtgattcaggtccacttacttctagaatgctcag

SEQ ID NO: 411704 - DNA, 451 bp, Homo sapiens
gttgggagacaaaaaagggggaagggggggcacgaaggcccaacacaaaacaaaacaagaaaaagcaacaaactgctgatataagcatcgacatagatgaatctcaaagacatcatgctgagttacagaagccaaatggtgcatgctgtatgattccaactacatgagtttgaggataaggaaaaccagtgcaacagaacaggagtgtggttaaaggagtgagtacatttgtcaagcctgatgagactgtatggatttagatctgtacatttcatgatatgtaaattatatccccttctctccaaaacaatagtgattaaggctctcgaggttaagatcaaggtgttcaatctagctttttaaattccgcaacagatagaatggatgaggtggccaatcttggacaataaatatagtacatggctatttttcatttttatcagtctaattc

SEQ ID NO: 411705 - DNA, 347 bp, Homo sapiens
acacattcattggtttatttctcaggccatacagaacaatgtctctgatatacctgagagcttctcccttcaagtatttgactagaggcatgttgttctgtactggatctctgatcctcctcagaccaccttcacctgggagcttcaaccacacataaaacagtatatatggttgctttctcttatgtagaatgtatctgtgtgtatacatattaatatatacaaatatgaatatacagtttcaaatttattctttttcacgtctaagaatagtaaccatataaatagacatgttttagtagagtcttcaatgttttttaaaatattaaaaaatagatttttttaaa

SEQ ID NO: 411706 - DNA, 371 bp, Homo sapiens
gttaattatttctctaaaatgtaggtttaatgtttcatcttcttggtagcttacttatttcaaacgcagaaagttatcaaggaattccgttcctttttttaaaaaaatattttcagaaaaaaccacaatatttctgcctttgactctccttattttctttgaatctaaataagaatatctaaaaataccccatttgaaggaactggatttcttcccccaccccagaaaaaagaaatatagttttatctgtaagattagtgtgttgagtctatttcattcaaccttgtgagttgaacataatttaaaggtagtcttatttaattatatgaatgtgcatattaattaaaaagcagttgactaagcatttcaaa

SEQ ID NO: 411707 - DNA, 466 bp, Homo sapiens
ctatccctgttaccctccaaaaacaacagttaaatcttgggaaatggacaggaactcccaggcagacacataggagtgagatggagcataaggggcatttttgggcctctggcctccatcgctgtatggtctgggttctcttctctgcccagtgtttgcagcactgcctctgccccttatgtacccctgctttcctcactttcaggcttccatgcttctctgtgacatcccccaaaaacaggcagagtctaagatgtgcatgtacccactcaagcctcaagcttgtatctgtatccatatccagggacatgaacaagaactgaggtagccattggtttaacttagagcactctcaaagttcagatcagcgttatgtgtgtgcatgagtgtggtggggagattttcccctaggacaaagagactttccctcccatttttgccattgtgctagttaaaaaagaaaaaa

SEQ ID NO: 411708 - DNA, 443 bp, Homo sapiens
tctgaaaagcttttagatattgccatatttaattactcccttcttgcctctcactctgttcgtttttttagctcattacacaacactgtactgaacaaaacaagaagcctcattgaattccttgaagtgatttttgggcaatgggcaaaacaacttattcaggcatctagtactatccaaattgctgataagtcgaaggactttgttgggtaaagttgcacaactgaaaaacaggagaagaaatgtacagattatcttgcgtttgggattttatctttggttcaggggtcaaagcagggtttcaatagcaaattactgaagtatttgaatagtgaagtatttttgtgatttttttttaactttaccgctgtggagagactgttcactttcattaaaaattacagggcaaatacccaaactccttccaagtcaaaaggatgttg

SEQ ID NO: 411709 - DNA, 447 bp, Homo sapiens
ggctgaccggctgcaggcctccgcccgcggatgctgagaaccgcagctgcacaaggtaggctggaaaaaccccactgcggtgaggcggaagcctagtgccgccggaaaggcaaaatcctgctcgtgtgaagctagacctatcaggacaagagaaacctaggactagcgcaggacaggcgcttaataagcatttctttgggtgaatgaatgaatggatgaacaactcgaggaggtggtgaagaaaaataacgctaacaaagacgtactcacccaaaatgaatactatggctaataataaaaatgcataccaatcgtaagtagaaactgttctgccgctgtcggaaattactaaaatggaaattaccctgaacgactttcatccttcatctgacagtgaaaacacttagaacaacgaaatcttgcagtaaaaatatttaggactaaaaa

SEQ ID NO: 411710 - DNA, 422 bp, Homo sapiens
ttcctatggtcaggtgctgtgctgtgtgctgagtatggaggaggtaggctgagatagatgtgacctttgctcttgcaaagctgatatactaagggttggacagatgctaaatgtgcaaagaaacccaatacttgcagatggtgctgggtactaccaaggaaagaaatagggtatatgacagagtacctggaaagggcactggccagcttttatgggcagggaggtcaaagcaaacctgtctggagatgagacaggccaggaaaatcagggcaggggccagagtagggcaaatgtggtgcctagagcctcatttttttttttagacggattctcgccctgttgcccaggctggaggttgcagtgagccgagatcgagacattgccctccagcctgggcaacaagagcgggactccatctcaaa

SEQ ID NO: 411711 - DNA, 487 bp, Homo sapiens
ttacaagcagttgaaataatatgtgcccttcccagtccctttttagtatttgtcagtagaatagagtgtcaaaaacgacttacgatgcctaaaacatttagaaattaaaatagcatgtggtggtgccatgaccttttcaatatgctggtgtttcaattgttcagccattcctcttgttctttttcctgactgttctttatcagaggaaaaggtaaattggcacctcaagtatggagtactcaaaggaactaaacagcacattattgaaacaattcagaggcaatcccgcatagcttccaagtgccatggaaacaaaagatggtaactttattaattgtgaaaggttgggggaacgaatttagtatcttgctttgccagttttcctctagtgcacagtatagtttccaggacctgcatacaaacatcagttcatgatcaaaatgtgaccttgcctgtcccgatgaataaaactaataaattccccaat

SEQ ID NO: 411712 - DNA, 427 bp, Homo sapiens
cgaaagaaactgcaagagtttgagccaaaaggatggactgttggagtagctgagggtgaagctgccggaactcctcaaagtggaacagcaaagccagcaccagagatggacaagaaaaacaaactatcaacgaaaattcgcagaaatcaaagttagatgctaaagcagcgaaaaaccgttcacgccacgatagaaacagagttgatgatggagtctgagaaacgaatcttagggagagaaaggacagcagtgaacatggtcaggtgctgaggattctggtccactggaccccaccatccctaggatagtaaataccatcccagtcatcacccagcaagttaccaccacagcatttcctgtgtgtttcaaaaaaataaataaaggtgattcttaacataagtgcaaataaaaagtcattcatcataat

SEQ ID NO: 411713 - DNA, 397 bp, Homo sapiens
caaacgatgcttggataattggcaagccacatgtagaataatgaaactggattctcatctctcaccttatacaaaaatctactcaagattaatcaaggacttaaatctaagacctgaaatcataaaaattctagaagataacattggaaaaactcttctagacattggattaggcagagttcatgaccaagaacccaaaagcaaatgtaacgaagacaaatagatgggacctaattaaactaaaaagcttctgcacagcaaaagaaataatcagcaaacagacaatcagagtgggagaaaatattcacaaacgatgcatctgacaaagattcagaatccacaaaatctgacaaatattcagaatccacaaggaactcaaaaaaaatcagcaagaaaa

SEQ ID NO: 411714 - DNA, 515 bp, Homo sapiens
catgctaggctacttgaaacttccagcaattcatccaattatgacttacgtgtttcttccgcattatgcttctgctgctttgctccaaataaacagatctctaccggaactgtgtaagaatttccgtatcttttcagattctgggtgccagtttgccctgcaagctcgcttctctaatagatccaaaaaagtcaatgattttcagggttcaagtttttttgttgtttatttattttaaggtcaaaaatgttgtcttccatgctcattacatgtcacagttaaaatggaaattaatttgttatacaattgatagaaacaaaagcaattactctgctcaaagctaagaagtattttacggattcattcctactgactaatttacagatttttttggtatatagtgtgttcaaaatgtcaggctgcacattacagatataaaagtgcaaaaatctccatcccatattttacaaaaattttattgtgtatttgataaagtaaaatttattgacaaataa

SEQ ID NO: 411715 - DNA, 491 bp, Homo sapiens
tcccaaagtgctgggattacaggcatgagccactgctcccggctgccaatttttaaatcagatttttgttttttggctgttgtttgagtttcttatatattctgggtattaacccctggtcagatgcatagtttgcagatattttcttccattttgtaggttgtctctttagtctgttaattatttcctttgctgtgcagaagcttggcttgaaattattaaaagtgtgatttctatgtgtgaatcaatcacaagacatgtcaaaaggaatttctttttcctctggaggaaaaagattaaacacaagggttcacaattgactccacgtggttatccacattgtgttgtcacaatgattgcacctgaaaactcatctaggtctttggaaagaagagaatggaggactaacatttactgggacactcccatattatgtatctgcctacttctattaatatagccctgtgcagctcagatgtgctagcttttgt

SEQ ID NO: 411716 - DNA, 480 bp, Homo sapiens
caggaccatggcaaaggcacacaggaaccaaactgaaagagctgtcatattctaattaagcttggaattaatgagttttttaaaaagatatttttacttcatttctttgattgatagtaatgttaaacatttttttcacttttactatttatatttcctttgtaaagcatctgatctggccttttttcatttttctataggtgcattagtggttttctaattgatttgtaagagctctctaaattttttgcaacattaatctttatatgtcttaacctaatatttctaggtatttttagaggctttttcttgcttgtaaggcaaatgaattttgtttattatttcatgtctatttattagtgatcaattttatgaatttatgttggattgtcccataaagaggcaaagggctattaattgaatacctactgagaacaattataatgataaaatctactttctccatattctttaaatcaa

SEQ ID NO: 411717 - DNA, 479 bp, Homo sapiens
atggctaacggacttcccagtgccctgttgggtttctagaaaacagaatacaacatcgtctgagatcacagtcatatcccttcaagtgttttcaattaaatgacatgagactagacaattttaagacttgtttgaacacagatctaaaatgctaagttcctaatgtcatgtccactcttcaaatagtcaaaaacaagctccaaactaattattaattgggaaatatgctaaccatgctgaaattaatttttttttaaatcttaacttgctcaaagaaacatgaccagttccctggtcaccttcattaaaataccctacattaaatcttgcatttagagtctcacattcagcagcaagctagaaatcacacattttcaaatgataagcagaaattaatattagatttatttgctttctttctgaatgtgttagtgcccagggctctgacaactacacaccattgttttgtgaaggaaaag

SEQ ID NO: 411718 - DNA, 516 bp, Homo sapiens
aatccttgagctatgcataggcagctcacaaatcacctctgtctggtacatggtatattctaatggcaataaaatggcacaagcagccttgtgtgccaggcactgttctcggcacttgtcatgtattcatttaatcctctcagaaaccttgggtggtgggtattgttactaccccccattttccatgtaagggaagtgaaacttcaggatgttaggtcactttgtctattttagtcatcactgtataccaggattgcaagctcaaatgtgcacaggtggctaaaaaaaagttgtgaccactttccaaggtgagactgatagtaaactggagccaggatcagacccagacaatctggttccagagctggtgcttgtaacttctgtattctacttcctgcaaaaccaagaaaccagcctccatagccagttataagtatatagagggaaggaatggagctagatctcatttgaccaaagattctagttgaaaataaaagtcatctggtgtgttccact

SEQ ID NO: 411719 - DNA, 625 bp, Homo sapiens
ttccattacctgctttacaggattgttgaaaggatcaagtatgttaatgtatatactagtactttttagctgaacagagaaaatttatgtttagattctatccatctcattgattctttctattaaagacagatgatcctggcacacttttgcttaaattttatttcagtgttctgtgtttggcaatttggacttggcctgtaatatcttctgttgctgaaccctttcttctcttcatcgctcttccataccatctgtagctatgattgtctgtagttgtcaccagagactttgttgctctttaaatagtatattgtatgttacaaaatacataatttctacctaccaattttctgatcttatggtctattttcatatcttatggtcatgagctaaaaattaatgtttgcttattggggaggggcatgatagcagcaggctggagaccttcaggtgaggctttgatttcagtgataggtgaggattgaattcatgaatggcttgcaaatattgtgggactggccttgtacctcaatcagtttgtgtaacattttagaatgtagtagcttttctccattgtcatttgaattttgatgaataatgatttatttttctgtctttaaaa

SEQ ID NO: 411720 - DNA, 734 bp, Homo sapiens
gattttgggtcattctaagggaaggctttaggctctgaatctgtctgcctgggagtggggaaattgtgcagtatagcctccttccatgggataggaagcacctgtccagacctgtataattgtgtggaagccagcctggaagtaacttgctccacaaaaattaaggagttttgcaccgcatgttctcgcttataagtgggagttgaacagtgagaacacagggacacagggaggggaataatacacactagggcttgttggtggtggggggtgaggagaagtaacttagaggacaggtcgataggtgcagcaaaccaccatggcacacatatacctatgtaacaaacctgcacattcttctgcacatgtatcctgtaacttaaagtaaaaataaaaaaaaaattaatgagtttaggagctagcagggaacctgtggctggcacatagtgcatataacccctaccttgtcctttacaaatggtcatttataacttcttatttaaataataaggatatactgtgtttggaagtagttggtcttttttttggacgttttaattgctagagaaaactttcttatatggatctaaaatctgccccattgaaactcagggcaggtacagatatttttattcatcttagtaattccttgctgttactctactaatattatccttgtatctgaggtacctgatgcttcagaggtgctcagtgaataaatgttaaattgatgt

SEQ ID NO: 411721 - DNA, 532 bp, Homo sapiens
acaggagaaattcattttaataatttatttaacacattcaaaatattgtcattttgacatgaggcactagccacatttcaagtgttcaatagccatctgttgatagcacacttctagagaattaataatcttcatgacagacaaagccttagtatgatattgaaggaacatgcaggcatcctccaggtcacagctacattctggatcatttttcctaccatatctacataggtctctgtgatctaattggccagggctacaggaaaggtgggtctaatctatggcctttgaaagggcctgtggaaagcagccgagtaaacatctagtgcaacatatgctcttgtaaaggcatatcactggctaaggggcgaaacattctgccagtgggacagggtggattagaaaagacttcacaaggccaggtgcggtggctcatgcctgtaatcccagcactttgggaggctgaggtgggtggatcacaaggtcagagtttgagaccagcctgaccaatatggtgaaactcgtctttact

SEQ ID NO: 411722 - DNA, 392 bp, Homo sapiens
taatggtagagttaaaggccaaatctgccatatagttaaaggccaaatctgccgtgaagccaggagaaaggatccagcatacaaaccatgacagaatacacacacattttggagatgcatgctttctcaaagctctgaggaccatcatgaagacatattaactgaaagaatacaaagcgatgtgaatagttcctaactattggagactatacaagaagcatgacaccaaactgtggttgtcttctggtgaagatctcagaagtttccactcatggcaaaaggtagataaagaaggagctaatgaagaaaaagaaacaagctgtcaagcggtgggaagggaaccaggaaaacacagcatcatgtcagacaataaaatagtgtaatttcaagaa

SEQ ID NO: 411723 - DNA, 343 bp, Homo sapiens
ttgttctgactttcagcttgcagggatgtgggcatagaaaacaagaggctgacttctcaatcaatcgtcacttaaggatgcagagccagtggaagccctttctttcatgacttttagcattttttcttcattttcagaaaatccacaccatctccatatatgcatgcacgcatgagtgtccgtccgccccctaactgtggggttaagaatcatgtgactgctcatgctggaaaaacaagacaatcaccatcataaaagcccacatcatttacagatcttggaacttgaactttctttaaaagataaatatagtagtttacattttggagctggagacattgtc

SEQ ID NO: 411724 - DNA, 375 bp, Homo sapiens
acagggtctcactctcttgcccaggcttgggtgaagtggcacaaacacagctcactgcagcctcaatctcccaggctcaaaggatcctcccacctcagcttcccaagtagctgggactataggcatgcaccaccacgccaggctaatttttctattttttgtagagacacggttttgccatgttggtcaggctggtctcgcactcctgacctcaagtgatccacccgccttggcctcccaaagtgctgggattacaggcttgagccacctcacccagttgaaagtaatttttaaaaactttttattgtggaaatattctaaactatataaaaatgtaaagatgctgtaataaactaacaggaatccatcacctat

SEQ ID NO: 411725 - DNA, 458 bp, Homo sapiens
acagaagtgacacaatctgactttcttttaaaaggaacactctgctattgtgctaaggatagactgcagaggcgaggctgaaacatgggggaccagttaggaggctgttcccataatccaggacccagaactccagcttcagagtccagtgctgctaagccatagtttcttagcacttcccctgtaagttactatgaaaagaagtctggaaaaatgctaccgtcaagaagtttgaaagtcaatgtgtcctcttttatgctttcttttgtctgtgaaaagctaatgtcaaatctttacctttgtgcagggatatattttttgatggttcagtgaattgttctctcccaaacagtaataattttgagtaactcttgttctatctgtacataaaaaacacagtgtgtgcttatagagctgtcagaatctgcgaggaaataaattttaattccatggcaagg

SEQ ID NO: 411726 - DNA, 476 bp, Homo sapiens
gtttactacgcttagctcctacccctttttgtcctctcacaattttctgcttctctccacttttcatcaaactgttaaaaattatgggaggccattcttttgggctgagctcctgcactagccctcaacagatcagaccaaaccaaaatggagttacttatgctaaatgctgtgtcatcaaactgaaactttaaggaagcagatagatccccaaacagaccagtttttcctgaaaacatgagattccagtctacttgaatcagcggaagaaggaagtcccctctgctttaactattacaaaaaagtaaccgaagtagcttgatgttaaccaatcaggtttttctattctgtttccttgttgctacctcataaaacctgtggttctgctattgcccagtgggagctctcattctgttttgtagagtggaaggtgcccagattcatgaatcatgaataaaagccaattaaatctataa

SEQ ID NO: 411727 - DNA, 378 bp, Homo sapiens
taagcatagcctcagctgaccgcaatacaagaaatcagctcaaggcttttgtttctgcgatttcctcagtttttctgttttagatttcatttatttttgatttgatatttagtatttcctttctgttcatttccttagaacttcttgaagtattgtttctaaattcttgaaataaagtttaattcatttaatttttgattctctttgtttaataaaagttgtatataagatgtgaatttacttttgatgcagctttagttttactccaaaaacttagatatataaatattcctaattttattattcttctaaattgttatttttttaaattaaaagtgtaaataaaaaataactaaatttataatgtattttctcctt

SEQ ID NO: 411728 - DNA, 240 bp, Homo sapiens
gaatagtattggggtaattcattttcccactcagttaattccgtggttggccttttgtgcagtttgacaaatcaagacttcttgtggagactggagagtaatttcattcatagctgagaaggatttttttttaaagatggctaaagtcatttatagttctataaactgaattattatgtagctattctcttatcttttttggcagtctggagcaaaatccatacttaatagtaagtgaaa

SEQ ID NO: 411729 - DNA, 562 bp, Homo sapiens
caacagtggggtatcatttgtttggtgaattttaacgtttgcatgagatggtgttcatgtttgtgaaaaatatcgaagacttctgacttctttctttttaactgcacatggctcaatctaataaattttcaatatagattctgatatggttataatcccaatcataccacatttaaaagctatattcctgactgtgtttctctgctagcatgacgccacaaggaaaatgaaaccaacccaaacaaaaccctccttataacagaaagtaaaatgaagcttgtaacgactgttttgaaaaatggtttgaacagtgaggaacaaccaatttttcaaacactgttgtagctgtttcaagctgtagtgtggatagtgtatgcaagaaatcaataaagggaagagatctctctctgacacagatgaaacctaaaaatactgttaagaccaattctccctccatgcatctgttactgcattccactaaaaggtgttgggaaaaaaatcagccaaattctactagaacgaagcatccagacaagtgactcttcaaataattaaaaaaaaa

SEQ ID NO: 411730 - DNA, 755 bp, Homo sapiens
gaataataatttataggggactgcttctagattccaaaggaaagagaaaggaaatatgccccaaactcaggctttcagcctggccctgcctgactcactgagctgcattggacaaatgattcattcactggccttgacctcagtgggtttggccacccattgagagtgaagtcacacctccagcactgcgatgcatttattgatccactcacctagcttcatggcaggcaagaaacaggcctgtgtgagcctgcccaggatcagggacaggagagcacacaggtgtttctggatatcctcaagctgtagctgggctgctcgattcttccctaggagatcctccgggggcctgaattagtttgctagggcttccgtaacaaagcgccacagactgagcggcttaaataaaaatgtgtcatctcatggttctggaggctggaagtctgagatcaaggtgctggggattaggacttgaacatatgttttttgggggcacacttcaaccctccggagggcctgtgccccaaagagagcctccttctgtgtgcagtgaaggtgtgagttctaaacatgagaaaaaaacaccccttgttcttggatagggtgactcgataccacaaacaggtccaactggcccaggtaaatatattcgtttaacatgatcgtcaccaaaatattgagggtaggtgtttttttctggagttaaacaagttgattctggagttgatatgaaataataaacaagcaaaaatagc

SEQ ID NO: 411731 - DNA, 504 bp, Homo sapiens
aatatgcaggagttcatgcagaaaatgcagaggattatgaaggaagagatgtatttaatacaaaaccaatcgcacagcttattgaagaggcattgtctaataaccctcagcaagtagtagaaggctgctgttcagatatggctattactttcaatggactgaccccccaaaagatggaagtaatgatgtatggcctgtaccggctcagggcatttggacactatttcaatgacacactcgttttcttgcctccagttggttcagaaaatgactgaggcctggagaataatagacctgtgctgtccaagagcacttgaaatgtggctagtccaaattctgatacagtgtaagtgtaaaatacgtacttcattcaataattcatatattattagaaaacagtatgaagatgtaaaacatctcagtaatatttcatattgactccacattgaaataatgttttggatattttgcattaaataaaatatactattaaaattaaaatca

SEQ ID NO: 411732 - DNA, 1010 bp, Homo sapiens
agcgggttaggttatgacaggagcagcactgcagccacaagccatggcagtcgtggcccggggatcattccaagtctatttacagcagcaacattaaaccagccctgccaacatcctccctgtgcttgggccacgctggggctggtcacctctgagggcagcccccagcctcagtccaacatccttttctccatcagcaactagaacgttgcactggtgagcgcttccaggctggtaccaggtctcaccatggggaagggcactgtgtctgggcttgtgcaggtggtggatgcagagactggcaaggtggtcatcatctctcaggacctcgttcaggtgaaggtgctgctgcttggagccgtgaggatccgcagccccatcatgcagataaggatgggcacccagctggggaagaattggatacatctcccactgcttgaaggaggcagcacagcttctgggggcattcccagtgctggcaccccgctggtcaccaggcctgacttctccccaccgatgtccatctatatcacctggatcaccaaccaccagaaccctttctcctttggcaatgccatgccaggcctgaccttccactggtctgtcaccaagcgggacatcctggatctccaagggcagcatcacaagatgagccattaagtccagcccacattcaaggggagaggaagtaagcatcacctcaggcacagaagaacagaaagaagttgtgtgcatatctttaagacaaccacataccaggaactgcttttttttggtatagaaactatctttttaaaaatttacccttgacatttggaaacttcatccagctatgtctgatttgcaaattcaggtatatctttaaaataattttctttgatcaaaaaaaaaaaaaattttcagggcggatggggcaaggggcggaacttagaggggggccggaccagtttggtccttagaggggtaattgaactgggtaacaggcaagcgtcctgggaatgttcgtcaac

SEQ ID NO: 411733 - DNA, 470 bp, Homo sapiens
tctggggcttctggcttcctatgcagtcatcctctgccatgttcgtagggcagcttctgaagggaagaacaaggccatgtccatgtgcaccactcgtgtcattattatacttcttatgtttggacctgctatcttcatctacatgtgccctttcagggccttaccagctgacaagatggtttctctctttcacacagtgatctttccattgatgaatcctatgatttatacccttcgcaaccaggaagtgaaaacttccatgaagaggttattgagtcgacatgtagtctgtcaagtggattttataataagaaactgagaaggaggaattctggctggaattcatatcattcatttaacaagtcctgtttttcactgagtacctcccatttgccaggtaccattgtaggcaatggaggagagttatgcataatgagagaataaacttattatatttaaagaatataaag

SEQ ID NO: 411734 - DNA, 491 bp, Homo sapiens
tgctgctgtccttctcttctctttctcttcctcctcaccagggctcacttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgccca

SEQ ID NO: 411735 - DNA, 383 bp, Homo sapiens
tgctgctgtccttctcttctctttctcttcctcctcaccagggctcacttctccaacaaaatacaaccttttggagctcaaggagtcttgcatccggaaccaggactgcgagactggctgctgccaacgtgctccagacaattgcgagtcgcactgcgcggagaaggggtccgagggcagtctgtgtcaaacgcagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccata

SEQ ID NO: 411736 - DNA, 544 bp, Homo sapiens
acccattgcagcaccttcacaaagccgaggggctccttgaccacccggaactgacccccagccaccagctgaggagagaaacagtggggaaggggtggggttgttggaggtacagggaggtgagcggcaaggctgcccatcaatgaccccaggggatggagcatgtgacctcggggagagggtgagaaggagaaagtgacaccttggggatggtgtgagccccagggtccaaggactggtgggaaggtctgaagagatgctgaataaactaagaggcggagaggaattttcctaagttcacacagctggtaaattggtagaaccaggatatgaacccaggaagtctggctccagcacctgttactcttagccactgtgctaacttatcagtacaccatcttttttttttcagcacaccatcttgtatgtctgtgaaagatacctgataatactatttgcttccagagggtagggaaacttttcactttatacccctttgtaccttttgagactccatctcaaataaaataaaaaaataaacagc

SEQ ID NO: 411737 - DNA, 257 bp, Homo sapiens
ctagaaaaaaagcatgtcattcaactctctaaagcctccatttccaaatctgtaaaaagggagataatagtaggtccctttctactccatagagatgctggaatggtcgggtgagaaaaggcgagggcaagtgttgccccatgaacaacattcattaaggggttactgtgtattaagcactgtagagcacattgtaaattgtcaatattagttatggtgataaactctaaataaattatctgagaattgggatcaaa

SEQ ID NO: 411738 - DNA, 592 bp, Homo sapiens
ctctagggagaaatcttggctgctggcttctttaaagtgtttcacagatgaagggaatatcaaggacagacttaaaagagggaagaagactattgtttgaagccaggtgaagccttgatgactgtggtttgaattcactgggaaaagtggaatcgtcaagagacccgggctaactaaatccctctgggagcctcagcagctgaggccatcactcaaaattaagggtggtagattctcctttggacctgtaggcccaattcaagaactaatggctgccctgattattctgtagtctgtgttgtctgatggatccatatcttcctctttggaaagctgggaactagaaagaagtgttctatttgctattacccaagggataatactaccagaatagccagtggaatttgcctattacttttcttaaaaacaatctttgtgttctggagtaattttagatttatagaaaagttaccaagggagtaaaaaaagttcctacgtacccttcactcagcttcctctaccattaatgtctcatataaagataatttgtcaaagctaagaaattaacattggcatattaatattaactaaa

SEQ ID NO: 411739 - DNA, 786 bp, Homo sapiens
ctggtaatgtcatgtgggtactgtttacacttaataataagacctctttttttcaggggcccagatgtaaactgatctgaaacttgttcaaatttaccaccaaagcaactctgggaagcagtacaaatacagagttccatgagacaacacttaagagttcctcttggacaggaaagcacatgcaaacactgtccaacatgagtattcagacatgcagagaaatcttataccaagtataaccaaccataaatgggcaatatagcatttttactgaaaaggtaaatatagcctaatttactctgcttaagcatgatgctcagataggagaactaatctaccgtgtccacagaccagtgaatttactgtggggaaacagtaaacagttgaggtgacgtctatggtctaaggcctgcagaaattgagcaatggtaaagcctcaagaggagaatgttacaggttaagagagaaaaggagcagggtagtgtaccccttagtttgctcgacagatgaacagtctacaaagtagaaacatgacattcaggagagccaggcaccagaagacccagagggccagagatcattaaaaggaaaaagaaatcaggagtgggaatctcagccacactcccaaaggtggagtgttcaagtgcaggatgcagagaaagcaagatgcacacattctagactgtaagtcaacaagcaacttctcatcattaaataagaagtgcctatttttggtctttgttttttttataggaaaaaaagttaaaattaaaaaaaattctgaaa

SEQ ID NO: 411740 - DNA, 479 bp, Homo sapiens
tctgaatacccagccctgtggtgggctgaggggagtgcagtgcagtggcccagggcatggattgccctcctcaccactgaccacatccatcctgggacttctctgtgccacttactgggacctcaacaggctaatagtgagatgagctgtggaaagcccacatccctggctgagggctccacgcccttgcctcccaccatgtgctgagcttggcctgaggctggcgctgcgtcatgctggccaaggggacacatgcaggggatgaggctgcacgtggcctacagcaaacccaacctgcgcagtctgagatgtggatgctgagctcatacacctgtgccaggaccaacagaaggcaccccctgggaatgttctagatccagacctggtgatggttacccaggcatacacacagatcaaaaccaacatgatggacacttcgtatgtctgttgcacctcaattaaaatgtttaaaacaattt

SEQ ID NO: 411741 - DNA, 678 bp, Homo sapiens
actggcatggtactggacagagagcccaggtgcccctggggtctgacaaactctccctgggaccggcggggcttcctggatgggatgacctggagcagggccttgaggaaggcgtggagttcctctgggctggggagggaaggggctgacggcaggcagggtctgcagtcactggccaccaccatcagcacctttgtcctcccaggccctggagctggactccacccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgaaaaaaaaat

SEQ ID NO: 411742 - DNA, 692 bp, Homo sapiens
tcaagcccttgagcacctgaggatcaagctgaacatctggatgtggttggccagaagtctgcggtcctactgctgaactacttggaggcaccgatggcctcattgggtagtggacagcgcagaccgcaagcgcatgcaggactgccagcggggctccagagcctgctggtggatgagcgcctggacagagcaaccctcctcatctttgctaataagcaggacctgcctggagcactgtcctctaacgccatccgcgaggtcctggagctggactccatccgcagccggccaaactaaaactccccctcctccaccccatgcctgctctgctactgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacatcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgaaaaaaaaat

SEQ ID NO: 411743 - DNA, 554 bp, Homo sapiens
tgccaatgaaagactttggaagtggaaattcatctttgtaataatcctgttatctgtaggctgacctcaagccttcatgacattcagggccccttattcctaactgtatcttctatgttgggcattgtgctcttgcatctaacaggaaaacaactttcagtgttgccaccttttgaacagcagagatttctaaagattagaaaattactaaatttaaatatacatagttttaaaatatgatacttttctacccatgcattcaaatatattctaactttaaaatcctgtaaatacttatatttgtaatgattttacttatatgatccaattaattggcaagaatatgtggtgaaagattttttacatatttgtattgttctgtgtgagacatctattgtaagcattgcttcaggctctcatttttgtctgccttccaggatttgctggctcaagtgctgtgtgctagacttagtgtcagtcacaaaggggagggaaacttgcagttgagccagacagttttgttattcctttaaaattaaaagcatatgaaacag

SEQ ID NO: 411744 - DNA, 436 bp, Homo sapiens
ctttccagctatatatgtctttagtgtcaataactgagatgaggccaggcctatctgtttgggactagtggaaagcagttaagatttagactacgtcaagtgtatatcctaaattttatctaccttctggagggattgaaggatggtatcaggtgctgggaagttgtcttgacttaactctttcccctgggtccttctggtttgcatctaatacttgattattaaaagtcgcaaaatattaagcatctccacccagtcactgcagtattgtccttttttgtttgtttgtttgttttgttttgagatggagtctggctctgtcgcccaggatggagtgcagtggcgcgatctcggccctctgcaacctctgcctcctgaattcaagcgattctcctgcctcagcctcttgagtagctggaattacaggcatgaacca

SEQ ID NO: 411745 - DNA, 459 bp, Homo sapiens
ggctgccgcttcttggcccaggtcctattttttcccagcctcaagctcagggcttggctcttgtttattcattcaaaatctttattaagcacctactatgtaccaaggaacataagtgactgaagtcgcagtttctgttccctggggtttgccatcatttcagttccgtggcatccactcaggagcagccatgtgcaggccctgtttggatgctcaggggccagcaggagagggagggaaagatgcacatgtgtgctgggtgcctggtggtgcctggaacggaactgggcacatcacacatgcacctcctcccaccctcccactgtgcttttgagggagggcttgcttgttcactgagtgtctgccttccgctgccctgtaggtgctctggggaaacaacaccgacaccggggcctgtaccttctgcaggtaaaaacagccccaggcccagagatttga

SEQ ID NO: 411746 - DNA, 438 bp, Homo sapiens
ctcccaaaggatctttaagtgctttacagaaccccccatttcattgagagatgtgtaatagattcattcacttacatacgtagaaataacttgtcatgccgttaaattcctcttctataggaatcaaattagtgttgggaactcattgtcaaaagttacatcatgggcccagtggcgtacacctgtaatcccaggactttgggaagccaaggagggcggatgacttgagctcagaagtttgagaccagcctgggcaacatgacaacgcctcctctctacaaaaaaaatacaaaaattaggtggacatggtggtgcacatctgtagtccaagcaacttgggaggctgagaggcggaggatctcttgagcccggaggctgcagtgagcagagatcacgctactgcactcagcctggttgacagagggagaccttatctca

SEQ ID NO: 411747 - DNA, 452 bp, Homo sapiens
ggttacttgtgctgtctatcgagttgcatctgtaaatgtcatgagtgtgctgattaacacaggcgaggcatcgagtgatgcctggtgatgctgcccagcctggattagtctagatttgtatttctcccacttccatcctattaatccccagtataaacttggctaaagttttccctgactttttgggttgattccattatccctttgcgtgccctgccagagggcaatatgtgtataaaggtcttccccaaacctgaactgctaaatgattaacagtggcttgggctgcttaacagggtcagattaaagcgttgacctttatcctgtaggtaagaggccaagatccaagtggagaagagattttttcaaggaatgaaagtacgtgagaaaatggatgtgtagacttttagatcaggagctattttttctttttatctttttgagatggaatc

SEQ ID NO: 411748 - DNA, 519 bp, Homo sapiens
atagaaatagcatttgaaaagcatcttatgtggtagaggggaattttcttgtaaaggtataaactgtgagaaagagatgatgatgcccaatgtgggcaaaaaatgccttttcattggcaagattcgggtatatcactatgaaaagaaaaccatatatatttcttgtaactactgcagcggcaggcataaggacccggtaatgcatcatcatatgctacatggcagcttatcaggagtggctactcgagccaagagaaacgtggcaacacttcttacttgcttctcttttgcaagcgtaacctgagccccttgtgatacaggtgtcttggcaaaaggattgccttagattagttttagcctgtaaaacgggagaaaaataaaagcatttcaatcttatagtgttcagatgtcccaaattatggacccaatagagtagtggctgaatcttcttaagtattatttatttttaaacaaatgtttgaatagtaatataaccattaaagatactgagcccgtccc

SEQ ID NO: 411749 - DNA, 424 bp, Homo sapiens
agagcttcctgtgtgtccatgctccagtatactcgtctatggtagttatttcacaaagccaagcgagttacaaacgaaataaaatagtgcttaagtaaagaaactgaataggagaacatatactctctcttctcaattttatatttagaaaaatataccttcagaaattggggaaataggcatcagacactcagcttcatcattttttaaaagtttgctgtatgcgctttatatgtatgttttttgtgtatgaaccatttcaaagtaagttgcagacaagacagtttgctctaaataaactcaatgtctgggcacagtggttgacgcctgtaatcccaggactttgggaggccaaggcaggtggatcacttgagtccaggagttcaggaccagcctggacaacatggcaaaaccccatctctac

SEQ ID NO: 411750 - DNA, 419 bp, Homo sapiens
ctgaccctacagcagacgactgcaacaagataagggctggattactgtgttatgacttggtttatgtttcaaatatagagcaggacttgcagattgagatccctggaccaggagtgggaaattcttaaaggagccaggggcactgaacttggcagcatacccccaccctaggcagctcccagcttcctggaaaggactggataaagatgaataggagctttgcattgcagggagggggtaaagaacggagtgacagctgggtatgggattaggagagaagcggctatagctggagggtgggatgcagggggtatagcagttggacatgagggtgtgactgaacccgggtagggagaggggatgttcctccaggcccaggaaggaggctggaatttgagtaaaacaaagatgtaattgag

SEQ ID NO: 411751 - DNA, 409 bp, Homo sapiens
tcatggaatgaattcttctgttagtggagtgatgcatattgacagatccaggcacatcttcaggctgcccttctgtctgtccctcacccatatattcattctacaaatatttgctgagagcctattatgtgtgaggcatcatgctaagtgcataacataaattacttcattttatcttcacagtgtccctttaaggtagggtctcttatccccatatcttacccaaggaacccgaggcttagagaaacttaaggagataaaacaacctgcccagggtcacaaagtcaggattcaaacccaggatgtcagagtccagagcctgttaccagtagagggtcctgacaaatcagtagtcgtccaggttcttggcgttttgaacaaagaattggacaaaatgcacaaacaaagc

SEQ ID NO: 411752 - DNA, 611 bp, Homo sapiens
cagcagctatagggaaggagaggatttcatcagttaagccccagggccacttggccgccctgagccagccttttcattttctctgtggctccctcaagatgtatcctggctgggcgcagtggctcatgcctgtaatcctagcactttgggaagccaaggcaggtgaatcacatgaggccaagcgtttgagaccagcctggccaatgtggcaaaaccctgtctactaaaaatacaacaacaacaacaaaaaaattagctgggcgtgatggtgcatatctgtagtccccgctgcttgggaggccgagtcatgaaaattgcttgaacctgggaggcagaggttgccatgagccaagatcacgccactgtactccaacctgagaaacagagtgagactctgtctccaaaaaaaaaaacaagatatatcctgttaaatcacagcacagcagtgcgtgcctgtaatcccagctacttgggaggctgaggtgaaagaattatttgaggccaggagtttgagactagcctgggccacagagtgagaacctgtctcaaaagaaaaaagttaattcacatatataatacatgtccacagagatttgaaaaatacattaaaa

SEQ ID NO: 411753 - DNA, 443 bp, Homo sapiens
cgggaggatgggctgaccatttttgactcatcttgaaacagttttctttcccctggaattttagtttatctagttctctttgattctacaggtctccaaatcccctaaaaatatgatagttttaaatttccagcttttcccattcttacagtgaaatattggcttacaggatttacttcattttgcttagaagagttctcatattaacttgtcgggtgcagtggctcacacctgcaataccagcatgttgggaggctgagcaggggcagattgcttgaggccaggagttcaagaccagcctggccaacaaggcgaaatcccctctctacgtcgtagtgcacacctgtaatcccagctactcgggaggcgagccagaggttgcagtgagccaggattgcaccaatacactccagcctgggcaacagagtaaggctctgtctcaa

SEQ ID NO: 411754 - DNA, 364 bp, Homo sapiens
agtttagaaaccaatttgtgaaatgctaccgatctatatctacatattttcagtgaggaggaccctctactaggagcaggctgtatgcattgcctctgggttgcaatttgatgataccaaagctgggaaggtaagagaaatggttgagaacaggattctggagggactgctgaatggtttgctgaatgttggtagaatggtcaggtacaaaaccagcaagctcgtgctgccatagaacttgatgtgaggccgagcgcagtggctcatcctgtaatcccagcattttggggaggccgaagtgggcacatcactggagacaaggggtttgagaccaccctgagcaatatggagaaaccccatctct

SEQ ID NO: 411755 - DNA, 330 bp, Homo sapiens
agtttagaaaccaatttgtgaaatgctaccgatctatatctacatattttcagtgaggaggaccctctactaggagcaggctgtatgcattgcctctgggttgcaatttgatgataccaaagctgggaaggtaagagaaatggtttgctgaatgttggtagaatggtcaggtacaaaaccagcaagctcgtgctgccatagaacttgatgtgaggccgagcgcagtggctcatcctgtaatcccagcattttggggaggccgaagtgggcacatcactggagacaaggggtttgagaccaccctgagcaatatggagaaaccccatctct

SEQ ID NO: 411756 - DNA, 436 bp, Homo sapiens
gaggcagaggttgcagtgagccgagatcgcgccaccgcactccagcctgagcagcagagcaaggctccgtctcaaaaaaaaaaaaaaaagtagtttcagaaagctatttatgatgctatgcggactgacaatgttcagttgctttggaaggaatctgattattctctcagctgcatttcatttctctttgccctcttgctcctaccctccactcctaccctgtcccccgcccccaagtatttcaactactgttctggattcctccaatttctgagttctactaaccacagacggcagaacactggctgggttaaaccaagcatggaactagcaaagagttggacaattcaaaggcaaacatagaagaaagtaaacggagtaatataacacaatagtatatttaactttaccctaggtccaaatgatatttcagttg

SEQ ID NO: 411757 - DNA, 524 bp, Homo sapiens
agcagcaggtacaaatatgtatttattttttgttgttgatattaatacagatgattcaaaggtactcatattaattagttataccagtatagctacatttagataattcatgtaattacctaaatgaataatggcccataaaacatgcagatttagcaccagttattataatttactcatgcaacagaccagttagccatctctgaattgacgcatcatataaacttttaaaactgttgtgggtcggaaggacttctggctgtggctatgtgaaagaggttggtgaaaaagaggtcttgaaaacaaagaacaaagagaatttacactacctgattcaacactaactataaagctattaccaagacactgtggtgttggtgtaaggatagatatatagatcaatagaccagaataaggtctattcttatacttgtcaactaattttcagcaaaggtgacaagacaattcaatggataaaataaatatttctaacaaatggaacaattggatatctgtatgcaaaa

SEQ ID NO: 411758 - DNA, 336 bp, Homo sapiens
cgttgtttgtccatgtgagctctatgtgtgggcttctgcccaagggttatcctcgtgggactgggaggctgtctgcaaagagaagggctgtgacttcgctttgccttgtgtgggagagctgcaagggccccaccctggggtgcctgtgcccagcctggactcctctgttggagctcctcagtgacattattctaaattaaagtcccactctgggaaagggattcctgcacattgccaggctctgctgcactgttcagggtctagggagggaggccaggagaaggcccgcctgtcagggagagctgtgtgtttccctcacatggcccatggaatcga

SEQ ID NO: 411759 - DNA, 362 bp, Homo sapiens
aatctattttctttgattacctcataaataacaagagtttcatatcagctctcctgtctcttcctcctccactcttttcccctctttcacattgtgccaatcacacaggtggatgctcagtatcaccccacagcacaagataaataagcttggaaggtttcctagcaacatattgttctgggaacctgctctgtttccctgaacaagatgaagccaaatatcctagaatctcagccagatgggaaaggattagcttattgagagtgttattgccttttttaaaaaaatgtttcactttgaaatgaacctcttaatataagtagcaaaagtgacttttaaaaggacatgtaaaaatatccctt

SEQ ID NO: 411760 - DNA, 382 bp, Homo sapiens
gatcttgcatgttgagtatgaagatggaaaggaagctgtgagaactaaatatgacagaatcttgtgctggattggctgtatatagagagaagaacatggccactagactgtgaggctggtagagtgtggtgtgatgatcaggaatggagaacgagtgggatgtgtactcagaaggatgtatttgccctaaaggaatctttgaaggatcagcagcaatgtgattcaggtatatctagccgcgcttggttgtgccgtctatagtccatctctgtggaggctgacacggtggaatccttgacacctggagtttgaggctgcagtgagacatgattgtgcctcagcactgctgccttggcaattaagtggcactttgtctcaaaaa

SEQ ID NO: 411761 - DNA, 347 bp, Homo sapiens
caccccacaacagtccccagagtgtgatattccccttcctgtgtccacgtgatctcattgttcaattcccacctatgagcgagaatatgcggtgtttggttttttgttcttgcgatagtttactgattaaaagtcctgcaaatgtaccacaaacattttgtttttaaccatgtccatgtaactttatttgccaatcatttgacatgtgccacaccctctttttgaatttggatgtgctgacttgtgtgtcatgtcatccttttggtataaatcatatccaaaatgcattatccaggatttttagttttaggtttattaaaatttgatgagaacttaacgatacttgc

SEQ ID NO: 411762 - DNA, 376 bp, Homo sapiens
ttggtcccggggtagaaactatgatgggggttttgagtgcgttgccaggaccgcatgcccagggggcccacaccccggccccaggctgccccgcgtctcagtgggtggttgccatcccgcaccgccacagccctcgagggctgcccctgccttctccctcgcatacatccttggccttcgaaccttttcgaaaattaattctgtggaaatctcaagtgtgtggacgcagtgtgatgaatccctcttcctgcgccagcgattcgcggcactgctggtccctttctgcccactgtggttctctttccacagcgttttagagaaaatatccatcacatcattttgtctgtaaattctccaacatgtaaggactccttga

SEQ ID NO: 411763 - DNA, 423 bp, Homo sapiens
tctttagacttttaagtttagcatgaactgcttttataccacgacaggagactatgactggagcaagcgttactgtggcaggctgctgaattcatgcctaagaggcaggagagcagcgttcttcctgttgagcatatattaagcttggctgtgttcatttcactgggcaaccttacaagcagtggttctcaaactgttgggtctggaacccctctgacacccttaaagagtatggaggactccaagaagctttccttatgtgggttgtgtctatcaatacttatgaattggaaattaaaattttggccgggtgcagtggcatacctctgtaatcccagcactttgagaggctgaggcaggtggattgcttgagctgaggaatttgagaccaacctgggcaatgtggcaaaaccctgtttctac

SEQ ID NO: 411764 - DNA, 362 bp, Homo sapiens
agttccagctgcttcagaggattgcttgagcccaggagttggatgctgcagtgagctatgatcataccatcacatgccatcctgggtgacagaagaagacactattgtctcaaaaaataaaacaacagttgttcaggatcattaggaatatatttaatcaatgctttttcagaaatggtggtttaaaaataagtaggctaggaaggaagtcctaagtaggtattctggtctcagacttgtgcttcctgcaacacctttaatatctataaaataattagagtttttgattgtggagtaggcttgatttggaactgaggatttttttctagacatatattttaatttgagtttcactcactgcc

SEQ ID NO: 411765 - DNA, 339 bp, Homo sapiens
tatcagcctctggcacagacccctcagtgctaccctagggactcaggccctttccactccgcagcaccaaaccctcgggcagcccctcccttcctgcaggacatccaactttgactttatatccatctgaaatctcagctctggtacctcttgatgccgcccagagtttgtagccagaaacccagaaggcaagagctaacacacttcttcaaaccaagagcataactttggctttcaatgaagtcctagagaaataaactgtcagtcttctctggacaaagatcgaggctgcaccctaacagcctcttcctgtaggagacagctcaaagaaacaaaaaa

SEQ ID NO: 411766 - DNA, 452 bp, Homo sapiens
gggaccaccgagtgacatctacatcaggccctgggtgagtaccagggaaggcttctgggccgatccaagttgccatccttcacgtcagttctcttagtaaatcatcccaggcattcctaaagcaggttagtgcctgctgtctgtgttcccataatactttgtgcccatcaatggtcagtatcagttcctgcaccccactgttgtttacttatccatctttctgccaggctgggatgtctttaaggacagggattccatttattcattttcagcattttccagctactgtttgtttagaaaggcttttggggatcacattgtaaaggcagaaatggtagttatttttagctctttctttaaaaatatccgaaagtatttagcttctcctttcaaaataaaaagcattgccagtccgcagtccggcctgggcgacagagcgagactccgtctca

SEQ ID NO: 411767 - DNA, 511 bp, Homo sapiens
aataattctatatatatgaaataatatagaactgtatgataattctgtattgtagttaaaattttaaaagaaaaccactgtagtggtagcagccctacttcagcatttgacccaaatttcttactaatctcaaagtgcctgaactctttgatcttagatccaagatcattctttcacatcatgcaaatgtcctagcattttcaagcattccaaccactttgatatcattttcacaacatccctttggggttggtatggcaagtattattatgtccttctgagatgaggaagccaaagctcgggaggtaaaataccgggcctgaggtcacacagtataaaggtagcagagctgggaagaaagcccagatgttatcagcctacttcagtgcccttactacaaaccacaccagctcttatcttcatacacattattttgcctatcagggtaagtgttttcttcatgtatttttttcattttttagaaataaatatatgtaatccatcttccaaa

SEQ ID NO: 411768 - DNA, 432 bp, Homo sapiens
gtttctaccaaaaatacaaaatattagttggggtgctgtcatgtgcctgtggttggtcctagctacttgggggggttgaggtgggaggatcacttgaacccaagaggtcaagggtgcagtgagctgagatcatgccacggcactgtagcctgggtgacaaagtgaggccctgtctcaaaaaaataaataaaaataaaaacaatatccccactctttcctcaagtccaagccattcatgtacttgtgtgtgcttcacttgttggtgttatcccactctttgcaacttgttcattacgtgtatttttccttggctaaatcatgaatttttcgaaggcagattgtgcctttcgactctttttacccggggtctatcagtgtctgacttatataatgtgttgtgtaaaaagtttgctgaatgaatcccttggctgg

SEQ ID NO: 411769 - DNA, 463 bp, Homo sapiens
agctgattagatggtgcccaccagattaagggtgggtctgcctttcccagcccactgactcaaatgttcatctccatcggcaacaccctcacagacacaccaggatcagtactttgcatccttaaatccaatcaagttgacacttagtattaatcaccacatgcccgaaaaccatactctgtgtgtttacaaaagctccaactaatatccaactgcaggcaatccagaacattttctaaaacacagatctgaatttggtacatagagtaagtgagcaggcctcctatagtctccgctcattctttgcagaattgtgtaaattcttacacaattttattggcaagctgaccctgctccctatttctcttctccagatatggttgtatgtgtattgaaaattgaaagcttcctaaaacttaaagtataataaaaaataaaaaataaaaattgaaagcttcagatt

SEQ ID NO: 411770 - DNA, 441 bp, Homo sapiens
caggcaatgggtattatcaggttgagagaagatggggagaagctcagagggcctaatgaaagcgaggggagtatagttgagtgggacagggcatgattatgtaaagggaccataaagatctttcctttgtccccagtgtaggcctctggcttcttatggctaatatgctaaaccccagggcctttcccatggggccctggctggtttctctgttctcaaattcccagctataggagtccataggattttgtttgacttcctatccttagcaaacatctgagttgtatcctgatatgtgaactgacttcctgcaatgtgcagtctgtcacttggtcctagtcaggctgggttagaattaaatcaagaccacctttcttctcaggcagggagaggggagggtggtagaaaaggtatttcctgtctaaatcctataatgaccaa

SEQ ID NO: 411771 - DNA, 627 bp, Homo sapiens
ccaaaaacttgccatacttcaaaactggaatgctgctggaatttgctatgtatggggtagtcatatgtccaggtggcctgcagggccaccaagccacgtctctggttatcatcatagttgatgagtcatctattaaacgagggggttgggccctattatctttgaggctcctctaacataaatagcctgcgatgtaaagaatcatgatactactccatacctcagggcccttagtcacagtttgttgttgataatcatgataatgatggcaactaatctctctactaaatgtgttattagagaagtcctgagggctgggcactgtgcctcatgcctgtaatctcagcactttgggaggctgaggcccagaagttcaagaccagcctaggcaacatggtgagacccccaactctacacacacacacacacaaaaaaaaaaaaaaaaaaaaagaacaggcccccgtgggggagcaagagcttgaacagtctagactggaatgatacataattccccaaattaacagttcattctataactaaagttgaggtgattaggacccaacagtagccaaaggattctgtatctgtggattcaaccaacaatggcttgaaaatatctgaaaaaaa

SEQ ID NO: 411772 - DNA, 433 bp, Homo sapiens
caggccagccatcaagcttcctttccagagatgggagcactcggggtgggttgagtctcttcagcagcctgcaggaggcagccctgaaacgcatacagagctggctggctctcctcagcgtgctagtttcctggggctgccgtaactaagcaccacagaccaggcggctgcaacaacagacactattgtctcgcagcattggatgctggagatccaagatcaaggcgtcagcagggctggctccttttgagggtcttctcggtatgcagacgactgcttctatctctgtatacacaccagcttcccctgtgcgtatctgagtcacccatcacattgattagggcctacccacatgaccttattttaccttcatcttttttttgagatgcagtctcgctctgttgcccatgctggagtgcagtggcgcaatctc

SEQ ID NO: 411773 - DNA, 578 bp, Homo sapiens
attaaaactgtgctaaaatattttttctcacctattgcctcattgtgttggtgaggctgtggataaataagttttttcatactctgctcctgggatagttatctaaattgcaaatgcatataccctttgaccaggcaattccatttctggtaatttatcctaaaaataagcctgcacaagtgaaaaatgatatatatagaaggttttttatggcagcaatatttacaaaaacaaggttggaagcaacccaaatgcccatcaaaaggaatctggtttaaaaaatatggtacatttatacaatggaaaactagggaactgtgaaaagaatgacgatggtgtctattaaaatgaaaataccttcaagatgtattgttaagtgaataagagatgggttaaaaataagagtatgtaaaattaagactataaattgctaagaaaatttaaaaaataaacaaggccaggtgtcatggcttacacctgtaatcccagtaatttgggaggccaaaacagggggattgcttgaagccagaagtttgagaccagtctgggcaacaaagcaagaccctgtctctacaaaa

SEQ ID NO: 411774 - DNA, 478 bp, Homo sapiens
ccggctctggtccccttccagcaagggaacccagggagcaacaccaccagtccaggccaagagcacatccccagggcctctgggcagacagcaccttcctagcagcaggacgggtaggaccctgctgggccagccctgcacatccccacctcggcagccctgcacatccccacctcggcagccctgcacatccccacctcggcagccctgcacatccccatctcggcagccctgcagccagcccagcaagtccttgctggagggtgtgacccacttggacacctgcacccagaaccccatcaaggtcttggtcaggctgagaaagagactgtcacctggccggggacaggccagctctgcacaccagccccaggagcggcccatgtagcctgtggcccagggctgaggctggatgggaggtggctggcagcccacccactgtaataaagccccagccattggcccacagcaatctttg

SEQ ID NO: 411775 - DNA, 407 bp, Homo sapiens
attcataaagttaaaagtaccttatgcatttctttggagacaccctgtgaattctgtgggatcaagtccgagtccccttcatgtggcattttccatagaacttttgctactagattgtccctttactcaggaccttaaatgaagtgaaaataggacagccttgcaaacttttttaaggtataaagggagcatggggagagccaaggagtcaagaattggtaaaattaggaaatgaaatcataaaagtggatttcacatctttttttaaaattctttcagcctttgtacattttttaacccttccctgccttatgaaggcccacttgtacagctgctttacataccgctgattttaaatactgtctgtatcacaatattgtttgtttttatcccgtccttcaggagat

SEQ ID NO: 411776 - DNA, 407 bp, Homo sapiens
tcagctttctaaattgtaagacatgtcacagctctagtagttctgaaacaaattttttatcaagagtaaaaaacgagcaaagataaatactgaatactttggtataacttaattagtgatgacacctcagttgagccttctctatgcagctggagttttgcttttctgctcaaatgccctctaatattatatccagccaaggtatcattcaagtataaagacaacagctaaagtgtccttaaaggcaacagaccaatacctgcgctgttctgttttgcttcgtccacacagtttttattcttcttcactcatttaacatttcagccatggtgggctatgaattctttcttggtaactaaaattgtttgtaaacggtattaaaataagtctcctttttaccttcttgg

SEQ ID NO: 411777 - DNA, 443 bp, Homo sapiens
ggtcctttgactcccacgtttataaagatgctactggagttccacgaggggtaccagataaatttaaggcccgaaatcaaacagcttcaggatttgaatctgtgctgttttggtggtcaactgtaaataaaaatgtagattggataaactacatttattacaaccaacaaaggtttgttaactacacaagacatgccattaagggaacagcctcccaattaggtcccattaactaaatagtctgggaaaacaggatagccctagatacgatgctagcagaaaaaggtggtgtctgtgtcttgattggagtccaatgatgtacttttattcctaataacacagcccctgacggaacagtaacaaaagctttgcaggacctaacctccttatccaatgagttagcaagcaattctggaataaatgatccctttacaagtttaaaa

SEQ ID NO: 411778 - DNA, 708 bp, Homo sapiens
ccccttatttttgggaattggccggatacaatttccaccggaaccgtttgaccggttccgattttacccgacccctatagaaatttgcccctgggccaaaaatttcgcacgaggggtttaaagggattttgggagaaccctgtcccatgataaggggaagttgaagtgtcctttggagtttcatgtgtgggccctttgggcatgtttaattgtctgaactcttcccgtgaattgccttcaaatttggtgtttatgcaaaaataatttagaagaccataaaaatccctgaagaaagtctgagaaagaggtgcaaggagagagggagaatttccagcttcatcaaaactgtgtgcagatggagcctctgcaggccacagctctttcctcagcagacatcatcctgcctgttacagaggaagtgggcactgccgggcagagccccagctcttctgcaccacgttcaagaaggcaggcaccacacaggcaacctcacgcctccttcggaagcagatggaggtttttttttttttttttgcacaaggttactctaacctgtttgtcttcttggggtaacttgttcattcatatatgaattgtcacccattctatcaaacaaataaaatcaccatgacaattgctatttttaggcacattttaaagctataaatgagatcatgttagttaataaaaattatctcctcagttaaa

SEQ ID NO: 411779 - DNA, 460 bp, Homo sapiens
tccccaagaaggtagtgtactaggatcctattagtctgcttttcatatactgtacatcaagtataggaaatgtgcactgagtatactaaaagtatatgcaggattaattttacataaaggcctcttctgtaacatttctctattttttgaaatacaattgcaataacttcagtctttttacattcttctgctgcatccatacaatgctccactgctgttgagtgtcctttaactgtggaccaaaggcaacccctgcagtgtttataaaacaattttaagaccattcaggccacataagatgagaatgcaattttgtaggattacaaaaaagccattaatatgccagtcaagactacagttaaaactactcttgcactgcaacagtgcatatgacctttatgtgattgtacagtattaaaagttttttcttatgtacagtaaactttatcatatggcagaa

SEQ ID NO: 411780 - DNA, 780 bp, Homo sapiens
taggagtaaataacttctgttaaaacatgctgccgtttagtgaaccctgtgccacattactgtgctgaacacgcacataacgttatctccggtagcttcagggaagtatcggtaacctcgatactttataaatgctgtttctcccaggcactgtagcttgctggattcaacgatgatctaactccaaagtttcattccacagtagctgctcttcagtgaggaaggatttggttctccttccaggagtgtctgcatgttaagaggattgactttactgcgaagaaacctagcagacaccaccgtaaccagatcaaagttagtattactggcaaggggagatattgatgccgtgtgccccgataaaaatgcgttaagggcacatcacctccgagtcattttccacaaaaactcccagccttaaaccatgagaaaatttcactaaatccagtgtgagggatgttctacaagatacctgtaccccgcccccgccccccaaaatctcaaagtcatgaaagcaaggaatgaatgcggaactgtcacagattagaggagtaaggagaaagaaaaataacatgggtgggaaaattggtgaaatctgagtaagggctgtagtttagtgttatttttaccagtgttaatttattagttttggtaattctagcatggttatatgggatcataacattggagaaagctgggtgaagactgtgcaggaactcttaaccatttttgcaacagctctgtaaatgtaaaattatttcaaaataaatttttaaaagg

SEQ ID NO: 411781 - DNA, 358 bp, Homo sapiens
gcagcgccctcacctctcccactgctccccaaatcctttcactgcatcctatatccaagtcccccgatgcggaccctgttctcgacccacaccacgtccgtgcacctgcattctccccactgcccttattcctgctctccctcccccctctggctcacctcctcagccttacacactctgctttcccaccccgtttttcctcagctcggcgggcttgagaaaagagggacatccccaacccccggttcccggggagcatctgggaatgtagagaagttagtgaagctgacgtgaaatttcgcagagtaggacttggagaggaattgccctgggctgagtaaacattgacctgagacgg

SEQ ID NO: 411782 - DNA, 395 bp, Homo sapiens
ccatccatccttggctactggttctttaggctctcagaaggtattatggccacattcaaacccttcagcaccagcccacctgctcatccattcccctagtatatccaatccagcttggttttatggtttagtaaaatagcttggctactttacactaaagtatgaatagctaagtgcctacgaacacagtgggttctgatggaatgttactaagaaatgatgagaaagttttaaagtcaaaaaaatttgggtttgtatctccattcgctcaacgatcagctgtgagaatctcagaagcttaaataactctctgaaattccatttctgcctgtaaaaatttaagctgttatctatcctatataagaagttgaaataaagtatcttgtgtaccagga

SEQ ID NO: 411783 - DNA, 2031 bp, Homo sapiens
gccgtccccaaagctcgctgttcgcttcgctgcctgacagctgccctgccgccaccaggcagtcccagcttccccaaaccagtcttctggcctctgtggcgccccaggcccgcgggattcagggattaggatctggaagggtttggtccaatcccctatccctctcagcgtcctgggctcacctccccggcagcttagcgctcctcttccaaaactgcttgctgttctcagcggccattgctctggccgggggaagtccttgtaggcgggccaagggtttgcccggcgagatgcccccagaccccgcaatctgagggccaacccaggccgcttccccgccgccggtcacccgctcccagctcctggggacgccatcttggatgtgggcacccctccacccagcaccgctgccattggtgagctgcgcaagccgtggacgggccgaccaattgggagccggaatcctgcaggccgctgaagccgaccggtaacgtcaggggctgggcacacaggtggacggggaaggcggagcttggacgagccgagaggcggggctcaaagttcctacccgcgagagggaagaagcaggtaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcacgtggcctctccctcaccaccatcatcatcggctgcttcctcctttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaacttatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatctcactg

SEQ ID NO: 411784 - DNA, 998 bp, Homo sapiens
cacgaaggggtaggattatgagaagggataaaaaaggagattggagaaaacacgtgtgctggaattttcagaaaaaaatcgtagactatggcttgagagttagaaataaaagattatcaatttcgagtgggttcagtggctcacacctggaatcccagtactttgagaggcagaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcacgtggcctctccctcaccaccatcatcatcggctgcttcctcctttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaacttatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatctcactg

SEQ ID NO: 411785 - DNA, 1415 bp, Homo sapiens
gccgtccccaaagctcgctgttcgcttcgctgcctgacagctgccctgccgccaccaggcagtcccagcttccccaaaccagtcttctggcctctgtggcgccccaggcccgcgggattcagggattaggatctggaagggtttggtccaatcccctatccctctcagcgtcctgggctcacctccccggcagcttagcgctcctcttccaaaactgcttgctgttctcagcggccattgctctggccgggggaagtccttgtaggcgggccaagggtttgcccggcgagatgcccccagaccccgcaatctgagggccaacccaggccgcttccccgccgccggtcacccgctcccagctcctggggacgccatcttggatgtgggcacccctccacccagcaccgctgccattggtgagctgcgcaagccgtggacgggccgaccaattgggagccggaatcctgcaggccgctgaagccgaccggtaacgtcaggggctgggcacacaggtggacggggaaggcggagcttggacgagccgagaggcggggctcaaagttcctacccgcgagagggaagaagcaggtaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcacgtggcctctccctcaccaccatcatcatcggctgcttcctcctttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaacttatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatctcactg

SEQ ID NO: 411786 - DNA, 194 bp, Homo sapiens
tagctctctgatttatatctagtgacttgggggatttgtctaaggctacctctgccatcttgtcacgtgtctgtatgattttcttcctgcaggaggtgctctggtaaaacaagtataaaatgaatgtcaggatgttctccctcatggtgggcatcttctctgtccttaataccacccagttcttcatctttgac

SEQ ID NO: 411787 - DNA, 468 bp, Homo sapiens
tgttctgttgtgttctgtgaagcagtttcaagtactgattaagagtacaatgtggaaagccaaaacagggatatgagttgtgagctggattttgttctaagttgtccctttgctggctatggagccctgggcagagtgcctcatctgctgaatagagctgttattccttattgtccataactgttgtaatgaccttgggcaagtcacataacctctcagaacctcaatttcttcctccataaaaagatgtttggagcagaggataacaaagactttgtccagttaagagcaaggactttctggaattctttcagtgtacactgaacttgaacttgaccccacaagcagtgtttaaattgttaatgaaagttagctactatgcatgtaatatcactatatattctactttaatcaaatgtagtatgcaaaaaacctggattaaatatgcagtttatgaaacaagtattt

SEQ ID NO: 411788 - DNA, 485 bp, Homo sapiens
aggctgaagtgcagtggtgtgatcgcagctcactgcagcctcaaactcctgggctcaagcaatcctcctgcttcagcctttgtaggagattggtcagggtggtgggagaaattataggaaagacacaaaccttcttggaaggccgagaggttttgcaaaagcttcagaaagaaattatggctgaaggcagccaaattcttatctgaagcctgagagcaaagggcagataacaggggagttgtataggaacttacctagataaatttgtttattcctgtgtccagaaaccaacctttgatcattcacacacaggactgctgtctacttgggatgttgacaatgtttattgcccacaaattgtgtttgctccaagcctttgtcattaaatttgtgctaaataaatgtgagggccaccagcttaaggggactgctaactctcttcggcccctagtgctggcagtcccctagcctgctctctcactgaa

SEQ ID NO: 411789 - DNA, 925 bp, Homo sapiens
tcaagggaagtcgcaaaaccagacggaattcaagggaaggaaaccgactccgcctctgatggctgcaacagtatgcacattcagggaggaaaggaattagcagtggtcatctttctggaccatctaccacagtggctaaagttaacacctagaaaggaaggtcgtgttttcagcttctttgactgctgctccaggtgtcaaaccctgaagggtgagctgacgctaaagactgagtggttattttttccagaagaggagaaagattgaaaatgtggccggccgattctccctgatgatcacacagacagacctgcatgacagtcaaacagacaggcctgcatagcaccccagttacacagacgaatttccccagagctgccttaacattgagcaaatagttaaacctagggaaattggtgcccagacagcaaagctagaaatgaaacatatggtcagtaggagccttgcgtgggcttctccctaacctggagcaaaccaaaataatagagacagtctttcattcctagtgccaggacccgtctcgggtcaacgaaatctgagacagtcaaggtaacagaggcagctgttcgaatagattcattggagagtctaaggcagccctccagaccaagctgtaaagcagataagatagaaataatcactctggtaccacagtagacaggccttgtaggtactgggccgctcacagcttaatccgacttagaaagcatttttgcctctgaccttctagttgaaacaaaattagttaccagtagacttaggcgaatgctacactgcacacaggcgcataaccccaacctatataaacactaagacaattgttgacactttgagttggcctggtggaattatctccagccttctgcctgtatctggttacagcaataaattcccttctttccta

SEQ ID NO: 411790 - DNA, 389 bp, Homo sapiens
agtcagtgaacagtggtttctcttaaacccatttcaagatggggaagctccgcccactgggctgactggtcttggggctgccagactgttctgtccccgggcctctagcttagctgcttcttcatggagttccaatggcaggtacacttccttaagggctctgaaccccagtgggggaaaccctggcttgggcctagtctacccagcctggcacatcctcgctgatatctgtgactggaagaaggcaagtgtccttgtagtctgttgtcaagaaacaccttccgccggatggcactgtgactccacaaatggcaatcaccccttttccttcctccactttgcctttctctccttccttttgctgccaaccaaacaaaacaaacacacac

SEQ ID NO: 411791 - DNA, 420 bp, Homo sapiens
agcaacatggtgagactccatctctacaaccaatcaatcaatccaaaatcttgaacaaaccttataaagatcagtaaaatattaaaggcaaaaaaaaaaagcttaaaattatgtgtcccttaatacaagaatgatgaaataacaagctgaaaggtagaatactgaatatgaatacatatgtagctactatttttttcccaaacatctacgcacgtgggtcaactctcacactataatgctagggaaaaacacaagactgacagaggccatggcatccccagcacccagcagtgatgtgtgtgcccatgcacgctgtgcacaacaaaaacctagttatgcttacttaactcatttatattaataatatccagtgctgtccagaaacttccatatgttttaatgggcatataagtttaaaaa

SEQ ID NO: 411792 - DNA, 106 bp, Homo sapiens
gaaggaagaagggaaggagcccgtggagaaagagcaggaaaagcagggcagggataaaaagacaaggaaattaagtttgagtttgacactggttacaaaaaaaaaa

SEQ ID NO: 411793 - DNA, 347 bp, Homo sapiens
atcttagaaattatttcatgcacagcaggaaatttcataaccgaaaaaagagaaaaactggggccgagcgcggtggctcacacctgtaatcccagcactttgggatgccgaggcaggcagatcacttgaagtcagaagttcgagatcagcctggccaacatggcgaaactctgtctctactaaaaatacaaaacatattagccaggtgtggcggtgcacgcctgtaatcccaactacttgggaggctgaggcaggctaatcgcttgaacccaggaggcagagattggagtgagccgagactgcgccactgcactccagcctgggcaacagagcaagactccgtctca

SEQ ID NO: 411794 - DNA, 405 bp, Homo sapiens
tagtagagactgggtcttactttatttcccaggctagtctcgaactcctgtcttcaagggatcctcccatcctgacctcccaaagtgttgggattacacatgtgagccactggacctggtcccctttcataattgaatatgaatgtttaacaaatagatttgctgctcgggctgatttaaatctaatacggttaaagatgtatgactaaaatacaaggttgttaaataatactttgtatataggtaatatattcctgtgtactaattgtttttattgtggcaaaaaaacttttacacataacataaaactcaccctccaatagtttccaaatgtacagtatacttttgccaaccacatgcatgttgctatgaaacagttccccagaactccttccacccaccctg

SEQ ID NO: 411795 - DNA, 441 bp, Homo sapiens
agagaagacgacagaagggatctacagaggtgctcctgaaacccatttcacactgcctttcaggccacagagaccacagtcaacaagaagctaagatcctgtttacagcttcttcccctgcactggaacaaatacaccagagaaggtggggcacaatggctcacgcctgtaatcctagcactctgcgaggccaacgcgggtggatcccctgaggtcaggagttttaagaccagtctggccaacatggtggaactctgtctctaacaaaaatacaaaaaaaaaagaaaaaaattagctgggcatggcggcacgcacctctagtcccagctactcggggggctgaagcaggagaatcgcttgaactcgggaggcggaggtttcagtgagccgagattgcaccactgcactccagcctgggcaacagagcaagactccatctca

SEQ ID NO: 411796 - DNA, 749 bp, Homo sapiens
agtgctgggattacagaaggcaagcacatttttaaaccacaaaacacaaaaagtcagatccacctgcgagcgtgcattctgtctggcgtcagccctaatagtctccctctcttccatcattcagggccccagggagtcgagtgcttactcagcacttagaccaggggattcagggatttctgcctggaaagccccgtctctcctgtcttggtggtaacctggtcccttttacctgcagctctggcaaacgccagctgctgggtgcttcctcctccttcatgagaaaagatgagaaactggggtaaacaacccaccaagggcaggtatggagagaagaaggaaaggctaagacacagatgggagaagacagacagggagaaggtagggagaagatgacccatttggacctgctcctcaatgcccaagaagcagagagtttttcaaggacagctttaataataagagctcttcttcgaagctcagggggatggatggaggaagagtgtgagacccacagcaagagcagcaagctgacacctccctcgccacagctggaagccgctgcccactgaccaatcccatagacgcccttcactccccagcctccacacccctggttaagaggacccagaatggatagcacagttgttttttttccccctctcccaacctccctggggctcaaggaacgggataagggttatgactgccagatcagagactcaagtcacttcagatgttcctttttt

SEQ ID NO: 411797 - DNA, 255 bp, Homo sapiens
tcggtagagataggtcttgctatgttgcccaggctggtcctgaactggcctcaagcaatcctcccgcttcggcctcctgaagtgctgggattacaggccaccggcctgggctgactacacaacctttagggcacttcaccattttccataataccccagtggatctcgccctatgaaggcaagggcctccctgtatatcttgagtctgcatttctctctgaattcccaggttgttgtatttttctccctgcctgc

SEQ ID NO: 411798 - DNA, 310 bp, Homo sapiens
aggttggaaaagatctagagctataatctccgaaaggaagatttgtaatgcactgcgagttagaaatgtttttctcactgcagcttccttgtttcaaaaagagaatttttgacagcactgcaaaggcacaagaaaccaggcacagtataaaatatacaaataaaacaggtaccaaggaacttaaaacattcaacccataacgtcgtctaggtttttctgctttaagaaaattgactcaattcttccaagagaataaccctattaaaggctaaaaatggaagctcccagttatgtagaagatatttccatc

SEQ ID NO: 411799 - DNA, 741 bp, Homo sapiens
tagtgttcaaaattttctcaaattcatgtttatattttcattttcttttaatttttcattttcttttagttttcattttcttttaattttaagatattcaaaatcaaataggaatcttgttcctacaaaaaagatttttgaggaaaatacataccttgtagatccttgatcatccttttgctttacataattgaagacggggaggggatgtgaagtaatcttatccatcctccctctcccctcttctctccccctcctactctcttctttctcattgttctactttttagcaattcaactcaatcaagtttcaaaactcatttaccaagctgggcacagtggcatatgcctatagtcccagctacttgggaggctgagaggatcacttgagcccaagagttcaagactagcctgggcaacatagggagaccctgtatctaaaaaaaataggaataaaaaaaagagttgccagattttcagttatgtatttaacatagacaatttcaattataaaatataataagagaaataatccatagaaattgataaactttctgtgcctcggtctccccatttgtaaaaggaggagagtagtaattccttctaccttggaatcattaaatttaatgaggataaatcatttaatggggattaaatgagttaatacatataaagctctagaaagtaccacatgcagagtaagacatcaatcaggataggcttaggatatgctgcagtgac

SEQ ID NO: 411800 - DNA, 541 bp, Homo sapiens
ctaaaagtgccttaaaaaatattgaaacacttaaactaattaataaaattagaaatggagaaagttgtcttataccattctcacagcatttttttcaaaaagaaaatttacttattattgctaatctttattcaagctgtcatagtctgcacttttaaggaattttaaaatataaacaacaataatgcaagaatgaaaactcctttgacattctggatcatagaatatgtcagtatgtttttttcattgtataataattttaagtattgccagagtttaatgtacttgtctagagaacagtagttggtaaactatttagctttcctttattcaaccaaatttcagatttgaaactagcctatagcatattttcatttgtcatcattgacacttgatcaattaatagccttattcaatttttgtcatatacccactgttttataataatttgatctgtagaattttttcccagctatctcattgaagaaaactattaccagcatgttagcttataccaaggaaaattcattttctgatgaaa

SEQ ID NO: 411801 - DNA, 395 bp, Homo sapiens
ctcacattcaccctgtgaagtaataccactaccccatgttgtagaggtgattcttatggctcagcaagaatttagtgactccctcaaggtcacacagttagaaagtaggatttgagccgggcgcggtggctcatgcctgtaatcccagcactttgggagactgaggcaggcggatcacgaggtcaggagatcaagaccatcctggctaacgtggtgagaccccgtctctactaaaaatacaaaaaattagccaggcgtgttggtgggtgcctgtagtcccagctactggggaggctgagacaggataatggcgtgaacccgggaggcagagcttgcagcgagctgagatcacgccactgcactccatcctgggcgatagcgagactccgtctcaa

SEQ ID NO: 411802 - DNA, 556 bp, Homo sapiens
acaaggtgtgaagtgatttttaacgaagtctaagatccaaagtctaataaatctaggaattttttaaaaacttgaatgtattgcttttgaagtaaacaaaataactgatattacagactattttgcaatgaaaaatgatgagagtttgtgatacagactgcttttttcctaccctatatctattttctcttttttagtaacaaatttctgggctgaaaatctcagccttccttgcaggtcaacaagatagaagtgatatttatatgagtaggagatttacgaaatccatttttcctgtctttttttccgtgcctacaatgtggacatctaagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatcttatttgttgatgctattgtagttctgttattgacaataaaaattcttaaggatataaa

SEQ ID NO: 411803 - DNA, 867 bp, Homo sapiens
gggaaggcctttactcagaattcacaacttacactacaccagagacttcatactggtgaaaagctctatgaatgtaaagaatgtaggaaggtctttactcagctctcacaacttattctgcataagagaattcataccggtgagaaaccctatgaatgtaaggaatgtggaaaagcttttatttgtggctcacagctttctcaacatcagaaaattcataatggggaaaaaccatatgaatgtaaggaatgtggaagggcctttattcggggctcactactgatgcaacatcagaggattcatactggtgaaaaaccctataaatgtgaagaatgtgggaaggcctttatccgtggctcacaacttactcaacaccagagaattcacaccaatgaaaagccctatgaatgtaaggaatgtggaaagatgtttagtcatggctcacaacttactcaacatcagagaatacacactggtgagaaaccctatcaatgtaaggaatgtggaaaagcgtttaatcgtggctcactccttacacgacaccagaggattcatactggtgagaaaccctatgaatgtaaagaatgtggaaaaacctttagtcgtggctcagaacttactcaacatgagcgaattcacacagctggagctccgttactctcatggggactttgagaatggtatctgggtgttatggatcatggagcagaaatacagaaggagtctgcaaccctgatgactttgtggaacagccatactagctctggtctgcttgcctcctgtttctctttaaataaaattaaacatcttatttgttgatgctattgtagttctgttattgacaataaaaattcttaaggatataaa

SEQ ID NO: 411804 - DNA, 528 bp, Homo sapiens
gcactccagcctgggcaacaaaagcgaaactccgtctcaaaaaataaataaataaaaataaaaaaataaaaatacagatacaccactgtgaaagaggtgttccaacattaattactgacgaggtagacagtggaaaacttggagaacactccatgaagtttatattcttatcctgccaggcttcggaataatctcccatattgtaacttactactccggaaaaaaagaaccatttggatacataggtatggtctgagctatgatatcaattggcttcctagggtttatcgtgtgagcacaccatatatttacagtaggaatagacgtagacacacgagcatatttcacctccgctaccataatcatcgctatccccaccggcgtcaaagtatttagctgactcgccacactccacggaagcaatatgaaatgatctgctgcagtgctctgagccctaggattcatctttcttttcaccgtaggtggcctgactggcattgtattaccaaactcatcactagacatcgt

SEQ ID NO: 411805 - DNA, 1391 bp, Homo sapiens
  misc_feature (1387)..(1387): n is a, c, g, or t
ctttacagcctacaaaatcctcagtaactaatccatacagaaaatgaatgtaatgtggataaacaaaatcagacaatactgtagtgcataaaatattaaaattttaacaatattttagtatcagtttgacatttaaaagacttaagagaaaatatgctagtcagtttatttataaatttatctggttcagaaatatgctagaagcacactcaaaaaacctaaagacatttcatatgatataaaactatatataacagaaaaatgattcttcaaaataagcgcaggaagctcactaataatagcaagatttattaacatgagatctacagacatttaggagttttatgaaacccttgaaattatttgtgaaacgtcatgcgtgtgtgcatgcatgtgtggttaaaatctttcactacattctaaaaacttcaccattcaaaaaatgtaaagatagtgaagcaacgttttaaaatcgtagtggccacttccagttcatccgtttatccagattttctagtaagttttcctgcaacatattttcaatttggatgttagtacatgaaaaacttttaaagaatcaaataaaaagaatctacagaaaataatctactttataaaaatgtctgtttaccttttaagtgttctgtgtttttttttattatcatgcaatgtttttactgctgttctcaagttcattgtcttattttcctgtattccttcagttggtagtttttcaaaaatgtcttcaacgtgactgctgttcttcaaaccatcaggcagttcccaaaatgaagctgttgtacatgtatcaaacaaaatggtactctggaaatgttttccactaccaactttctttctcactgttaaatttctagaatgtgatcttttactaatacgaattttccttaagaggttcttacagacatctttcctctttgtagatttgtttacacttttgtttctcagtgtatgtaaaatttatattttgttttttgtaacaattttgatctaacaatgggaaaataggcttactttgtaatttatattggatttttagcagattcagtagcagtaattgcatcaagatgaggtgaatctttagaataagttgcgagaccagatgcaactaatatatctgccaaattgtttttctcatgaatgacatctactttcagttttgtttcagaatgatattccctaaactgaaaaactaagtctggtttacttaggaaatctcgaaaaaagattttggcttcttcactccaatgttttcctttagcaggtaagataccatataaaatacatggataactcagccttggcaaattcaaaagttcctcaggaacaactttaagatttataatttctgaataacgtatataaaaanaaaa

SEQ ID NO: 411806 - DNA, 695 bp, Homo sapiens
atgcagcagagactgtgtggagcggtggaaggcggggcacagagaggagctgcagatggttcctcccttgactaccgctggctctgtggccctggaagagtatgtgccctttccaagtctcggtgtctcacgcatacagcaaggggctcaagcaagaacctttcgacatttctaccaaaaaagctctaccgctgaggagggcaaaaatacagaggtaagggaacacggcatgaattgaaaacttgtgtttttcttcttaaaagccatgccaactttacatcctgtgctattatgtaccagtgcttctcttaagagttttaaatggagttttcccccaaaaatgtcttcaagtaaaattgatccacagaggtgtgctgggtttattcaactgcttcaggcaacgtccacttccaccttagcacatccatgtaaacctggggaatctgtggtaagcagcccctaagatggttccgtgtaactccacctcctggtattaataaccttgtgctcatattcacccctccccttcagtgtggcctggacctagtgactcgcttctcgtaaagagaatgaggcagagggaacagtgtgtcacctccaggattaacttataaaaagactgtgatttgcctctcagggactctctcttgctcactcattttgagggaaggcagctgccatgtgagctgccctat

SEQ ID NO: 411807 - DNA, 738 bp, Homo sapiens
gctgaatacattctttcaccggctcctccacactgcagctctctctgggtattactgaagaaacagtaagcactgtaaagccactccattagtccagtcagtgctttcgacattgtttcacagtgaaactcaactcttaaaatgatggacagtcataaaatactaagtcactgtacatttctcaggttccaaactgcagtgccttctagatagtaaaatcattatttattcagtagctgcctaaaattccacttactatcatcagggtggggagtgtggcaggtgcagtaagcgcagtaagaagttggagtgacaggaatgcttttcaatcacatgtgatgactgcatcaacaacacatccttattagctaagccatatgtaattggcttatactatttaaaaataataatgataatagctcagcattactcattttactctggcctcgtattacagaaaagaaaacttgaggtcaaggtcacaaggtcacatacacacagctaaatagtggcaaaactggaatttgaacctaagtttaaacttaaaagccctaaaagtgattttccactttagtgtaatgcctcaggcatttggcagttatttgttggcaaatgaacgagagtcattatttgtacaaaagcttgaagtcaatgttagactgctgaacaacaaaatacaaactccatgataaattgagaggttgtaaatagatgctctgctagtcttctactctggtg

SEQ ID NO: 411808 - DNA, 297 bp, Homo sapiens
caaaacccaacacctggtggttgcatgaactcagtgacagtcactgaattacaagtttcgtgtgtttgctttaaaaaaaaaagaaagaactcttgctactttatagcattctccaccctggcccccagccttcatgtccctcttcttccctgctttgattactttgtggcacttattgctgcctggagtaaattatggatctacttgttcatttattgttgatctcttcctttggaatttaagatctgagggttttgtttgtttgttttgttttgttttgtttgttttgggagtctc

SEQ ID NO: 411809 - DNA, 1183 bp, Homo sapiens
  misc_feature (40)..(40): n is a, c, g, or t
cataaaagggagcggcggggggcaggggccccggattganccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgctgtccctgccacagagccaggaaataagaagccccgtggtcagagatggaaggaaccccaggggaagagccagtcagaaagaaaagaggcagacctatgaccaaaaacctggaccctgacccagagcccccatcgccagactcgcccacggagactttcgcagcaccagccgaggtccgcacttcactgacggcagcttcccgcggttgttggaggtctctcccacccgttcagggccgaagcgggtcccaaaggggggaggagggctccgggggacttctcctccccggctcgggagtctctctggtggcc

SEQ ID NO: 411810 - DNA, 672 bp, Homo sapiens
taataaaaaaaaataatttattgtcaacaaaggtgatatatacaacaggaaaacagatgtaaatgagaacgggagtgaatggggtgcccagcaccctcacaccttggacctgagcccttctgagaagagcaatatcctggaggcctggagtgaaggggtggccctcttgcaagacgtgagagctgagcagccgtccccacccaactcagactcgggccaggatgcccacccagacccagacgccaacccagacgctgccagaatgccagccgaaatcgtcgttctccttgactctgaggataacccatccctccctaaaaggagccggcccaggggactccgccccctcgagcttcctgctgtccctgccacagagccaggaaataagaagccccgtggtcagagatggaaggaaccccaggggaagagccagtcagaaagaaaagaggcagacctatgaccaaaaacctggaccctgacccagagcccccatcgccagactcgcccacggagactttcgcagcaccagccgaggtccgcacttcactgacggcagcttcccgcggttgttggaggtctctcccacccgttcagggccgaagcgggtcccaaaggggggaggagggctccgggggacttctcctccccggctcgggagtctctctggtggcc

SEQ ID NO: 411811 - DNA, 786 bp, Homo sapiens
  misc_feature (40)..(40): n is a, c, g, or t
cataaaagggagcggcggggggcaggggccccggattganccctccccgcccgggctcccgacgcgccgaggtctcggggaggcccggacgcgccggtcgcaggcccggccggcgagcggcgggcgggcggcggggagggggctgcgcggggcgggcggcgggcccggcgctattccggccaggaggcgggaggcggttgccggctgcgcgccgaagcctgcgcgccagtcctccggccactgctatcgcccacggccgcaccatggccctaaaggccgagggcgccgcactcgactgcttcgaggtgacgctgaaatgcgaggaaggggaggacgaggaggaggccatggtggtggccgtaattccgcggcccgagccgatgctcagagtgacccaacaggagaagaccccaccgcctagacccagcccgctagaggcaggcagtgatggctgtgaggagccgaagcagcaggtgtcttgggagcaggagttcctggtgggcagcagcccaggaggcagcgggcgggcactgtgcatggtgtgtggcgctgagatccgggcaccctcggccgacacagctcgctcgcacatcttggagcagcaccctcacaccttggacctgagcccttctgagaagaggcctccattacctcttcctgtcccaaccctgcagaggcctgaagctgggcctgggcaccccattcactcccgttctcatttacatctgttttcctgttgtatatatcacctttgttgacaataaattatttttttttattaaaaaa

SEQ ID NO: 411812 - DNA, 527 bp, Homo sapiens
tgacccactggaaaccagtgtcagcataacaacagttacgagagctaaacctacaaaatagaaacacaagtaaaacttgttcaagtggtttgcagtcattgaacatagatcagctcctatgaaaacaaactccatggaacacaggagctatgtggagagttgatggagggacattccaggcagagagaacagcaaacacaaaggccttgaagggctcaacaccacatggaagctgccaaggcttggggctcgcaccatctgaagacatggtctgaactctacgttggccctttcagccatggctggagcagctggaacgcagggcatcaagtctcttggctgcacacagctcagggaagctggacctggcccatgaaaccactttttcttcctatgcctccagacctgtgatgggaggagctgccatgaagacctctgacatgccctagaaacattttccccattgtcttagggattaacattctgtgccttgttgcttaagtaaatttctgcctcattgtcaggct

SEQ ID NO: 411813 - DNA, 206 bp, Homo sapiens
tgacccactggaaaccagtgtcagcataacaacagttacgagagctaaacctacaaaatagaaacacaagtaaaacttgttcaagtggtttgcagtcattgaacatagatcagctcctatgaaaacaaactccatgggtgcaaacttatggttcaaaaaatgaacaagcaacttttcaatcttgttctataaatataaaagttaat

SEQ ID NO: 411814 - DNA, 592 bp, Homo sapiens
gccaaatgaacctggttgcagtgagaggtttcagcccccatcagccaaatgctcttgagcaggcctcatctggaaaataatgactgtgtctcaaaggatgacgaagaggaataaatgagcaatgtgtttcaatgagacagtatcgggcaggtgcagaggatccagcatgttattctgaaaccccagaagacgctgcagctaccaaatagaaggagcctggatccctgaatgtcttcatggaacagaacattctcctcactccagtctgtttgaaccagaatatgacctgagcaagaaataagccttaattatatttgaccatagaattctggtgatatttctatggctgtaagtccatgttgattaatacaaagggattctgtaaagcctcttctattaaaaaaagttgcccaaggagtgaaaggagagatattttctgtaattaagattttcataatacatagaacaggctatagcacctggcaatcaatcatatggggtacaacagaaagaggaaacattcctgctattaaattaaccaaactggagttcttgttatataatatagtaaaatttcctcaatctttcagcc

SEQ ID NO: 411815 - DNA, 366 bp, Homo sapiens
tctaggctgcgtcaatgattgtagtgctaattgttacagacatgaccacaatgccaaggcgaatggggacaatgaaatccatggctggttttaagggcaggtgcagaggatccagcatgttattctgaaaccccagaagacgctgcagctaccaaatagaaggagcctggatccctgaatgtcttcatggaacagaacattctcctcactccagtctgtttgaaccagaatatgacctgagcaagaaataagccttaattatatttgaccatagaattctggtgatatttctatggctgtaagtccatgttgattaatacaaagggattctgtaaagcctcttctattaaaaaaagttgcccaagg

SEQ ID NO: 411816 - DNA, 416 bp, Homo sapiens
gccaaatgaacctggttgcagtgagaggtttcagcccccatcagccaaatgctcttgagcaggcctcatctggaaaataatgactgtgtctcaaaggatgacgaagaggaataaatgagcaatgtgtttcaatgagacagtatcgggcaggtgcagaggatccagcatgttattctgaaaccccagaagacgctgcagctaccaaatagaaggagcctggatccctgaatgtcttcatggaacagaacattctcctcactccagtctgtttgaaccagaatatgacctgagcaagaaataagccttaattatatttgaccatagaattctggtgatatttctatggctgtaagtccatgttgattaatacaaagggattctgtaaagcctcttctattaaaaaaagttgcccaagg

SEQ ID NO: 411817 - DNA, 465 bp, Homo sapiens
cctagataaccaaattaatgaagctactggatacaacctcaatagagtacagagaaagcttctgcactccaaggactaagctactagaccatgtaaatcaggtagctcacacttctgactcaccttctaccttcattggacagcactgctttggactaaaatcaactaaaagtaaatttctccaggacgacttaggaatgtagaatctttgcagatctcccaaggatacgaataccacaaggtagtgtgtgcagatacactgtttttcccacagcctgacaagcccacgtggctccattttccatatttacaaagggctgcaaatgcaaaaactttcaggaggggccagataatgtaaatgagccaagagaggtggtaacaggtaagggaaggactttgacaacctggagacaaatcctttatatttaataaataaataaataaataaataaaactctgtgcagg

SEQ ID NO: 411818 - DNA, 385 bp, Homo sapiens
agtaagaaaaagagattccaaaatttgtcaactgggacatgtgtttaatccctatagtccttttttttctgtattcataagatacataaatttcccctatttatcaaatatatgattctattaaaaatggactgaaagattctaggagactcaaataccaactggaaaatgaaaattgctcaatgttaaaaagagtaagaacattctagacaaaggctgaagaaagaagtctctcacagaaaatgaactgacagtggggtgggaggctttggtggatggagtcagggacagttataggtgaaaagatgttctcttactgggaatttgagacaggaggaattagccaaaaaatgcaaagaataattagtgtaatttaggcctgggc

SEQ ID NO: 411819 - DNA, 1864 bp, Homo sapiens
gaattccgggccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatatactcagaacatcctttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacttgcagcggagccagcccccactcttgaccctcatgatggattgctacttgactcacaccaatgacaccgcctttctacaggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagt

SEQ ID NO: 411820 - DNA, 2114 bp, Homo sapiens
gaattccgggccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccaggtgaagcacctagggctgaacgtcctctccagagaaccttctctccaaagaaggcaggggcaagaccaagtagagaggcccctgtgattagggagtggcttgtgacaccctgctgacccctcctgctgcctgctctccagaacaagtcctgcagaccttcactgagctgtccagggaccacaatcacagcatccccagggagcagctgcaggcgtttgtccacgaacacttccaggccaaggggcaggagctgcagccctggacccctgcagactggaaagacagcccccagttcctgcagaagatttcagatgccaaactgcgtgcctgggcagggcagctgcatcagctctggaagaagctggggaagaagatgaagccagaggttctcagccaccctgagcggttctctctcatatactcagaacatcctttcattgtgcctggcggtcgctttgttgagttctactactgggactcctactgggtcatggagggtctgctcctctcagagatggctgagacggtgaagggcatgctgcagaacttcttggacctggtgaaaacctatgggcatgtccccaatggtgggcgcgtgtactacttgcagcggagccagcccccactcttgaccctcatgatggattgctacttgactcacaccaatgacaccgcctttctacagtgggtaccaccctccctgtgctgctctgcagacccacccatccctcagacctctcagggctggggatgggcagcacgcctgggctgaggtgttgtctgcttcactccagggaaaacattgaaacactagccttggaattggacttttggaccaagaacaggactgtctctgtgagcttggagggaaagaactacctcctgaatcgctattatgtcccttatgggggacccaggcctgagtcctacagcaaagatgtggagttggctgacaccttgccagaaggagaccgggaggctctgtgggctgagctcaaggctggggctgagtctggctgggacttctcttcacgctggctcattggaggcccaaaccccaactcgcttagcggcatccgaacaagcaaactggtgcctgttgacctgaatgccttcctatgccaagcagaggagctgatgagcaacttctattccaggctggggaacgactcccaggccacgaagtacagaatcctgcggtcgcagcgcttggccgccctgaacacagtcctgtgggatgagcagaccggagcctggttcgattacgaccttgagaagaagaagaaaaaccgggagttttacccatccaacctcactccactctgggccgggtgtttctctgaccctggcgtggcggacaaggctctgaaatacctggaggacaaccggatcctgacttaccagtatgggatcccgacctctctccagaagacaggccagcagtgggatttccccaatgcctgggcccccctgcaggacctggtcatcagaggcctggccaaggcacctttacgtcgggcccaggaagtggctttccagctggctcagaattggatccgaaccaattttgatgtctactcgcagaagtcagccatgtatgagaagtatgacgtcagcaacggtggacagcccggtgggggaggagaatatgaagttcaggagggatttggctggacgaatggcgtggtcctgatgctgctggaccgctatggtgaccggctgacctcaggggccaagctggctttcctggagccccactgcctggcggccacccttctgcccagcctcctgctcagcctcctgccatggtgacagccctcctctcctcacctggccccagctcctgccccattaaacctctgcaccagt

SEQ ID NO: 411821 - DNA, 418 bp, Homo sapiens
gaattccgggccgaaggtgcctgggcttgctcattcagtcacagtcacagccaccatgccagggaggacctgggagctgtgcctgctactgctgctggggctgggactggggtcccaggaggccctacccccaccctgtgagagtgagatttactgccacggggagctcctaaaccaagttcaaatggccaagctctaccaggatgacaagcagtttgtggacatgccactgtctatagctccaggtgaagcacctagggctgaacgtcctctccagagaaccttctctccaaagaaggcaggggcaagaccaagtagagaggcccctgtgattagggagtggcttgtgacaccctgctgacccctcctgctgcctgctctccagaacaggggtaaggctcccgaggttaagggatct

SEQ ID NO: 411822 - DNA, 213 bp, Homo sapiens
agctgatgagcaacttctattccaggctgggtgagcaccccagtagggaagggaaagcagggagcttggtttcctgctcaggcttggcaatagaactggaagtaggacccttgtgtgacaggccttcagcaacttagcctgtcgagccccgccctagtggaagcctgcactcacatttgcgtaccagacaagagaacaaacggagccaaccct

SEQ ID NO: 411823 - DNA, 388 bp, Homo sapiens
atggattgctacttgactcacaccaatgacaccgcctttctacagtgggtaccaccctccctgtgctgctctgcagacccacccatccctcagacctctcagggctggggatgggcagcacgcctgggctgaggtgttgtctgcttcactccagggaaaacattgaaacactagccttggaattggacttttggaccaagaacaggactgtctctgtgagcttggagggaaagaactacctcctgaatcgctattatgtcccttatgggggacccaggtgaggaactgggcagcccacccctcaatctcttacctgctcactctggttagagcatcacaatgccccgggcaggaggaggagtgacttagcctggcctctcagatggtg

SEQ ID NO: 411824 - DNA, 2015 bp, Homo sapiens
gacaaagacaattctggtcccacagtcttgcatctgactgcccgctttggccaccccaaggtggtgaactggctcttgcatcatggcggtggggatcccaccgcggccacagacatgggcgccctgcctatccactacgctgcagccaaaggagacttcccctccctgaggcttctcgtcaggcactaccctgagggagtgaatgcccaaaccaagaacggtgccacgcccctgtacctggcgtgccaggagggccacctggaggtgacgcagtacctggtgcaggaatgcggcgcggacccgcacgcgcgcgcccacgacggcatgaccccactgcacgccgcggcgcagatgggccacagcccggtcatcgtgtggttggtgagctgcaccgacgtgagcctgtcggagcaggacaaagacggcgccaccgccacgcacttcgcggcgagccgcggccacagcaaggtgctcagctggctgctgctgcacggcggggagatctcggctgacctgtggggcgggaccgcgctgtacgacgccgccgagaacggggagctagagtgctgccagatcctggtagtgaacggcgcggagctggaagtccgcgaccgcgacgggtacgcggccgctgacctgtcggacttcaacggccacagccactgcacccactgcctgcgcacggtggagaacctgagcatggagcactgcgtgctctcccgggatccatccgtggagctggaggcgaagcagccggattcaggcatgtcctcacccaacaccacggtgtcggtccagcctctgaactttgacctcagctcgcccaccagcaccctctccaactacgactcctgctcctccagccactccagcatcaagggccagcaccctccacgtgggctttccagcactagagctgcagacatacagagctacatggacatgctgaacccagagctgggcctgccttggggcacgattgggaagcccatacccccaccacccccacccagcttccccccgccacccccgcccccaggcacccaactgcccccacccccacctagctacccatctcccaagcctcctgtgggaccacaggcagctgacatctacatgcagaccaagaacaaactccgccacgtggagacagaggccctcaagaaggagccgagctcctgcgacggccacgacgggctacggaggcaggactccagccgcaagccccgcgctttcagcaagcagcccagcacgggggactactaccggcagctgggccgctgccccggcgagacgctggtcgcacgcccgggcatggcgcaccgcgaggaggcggaactccctgggaaccacgtgcctaacggctgcgccgcggaccccaaggcgtccagggagcagcagctgccgccgccgccgccgccgccgcccctgcccgaggccgcgagttcgccgccgccggtcccgcctctgcccctcgagggcgctggccctggctgcgggcagcgccgctcctcctcgcccaccggcagcaccaagtctttcaacgtgatgttcccgatgggcgacaactcggagctactggctgagattaaggcaggcaagagcctgaagccgacgccacagagcaaggggctgaccacagtgttctcaggcagcaggcagccggccttccagcccgattggccgctgccgtctgtgtcacctgcactgttaccagtccggagccccacaccgccagctgcggggtttcagccgctgctcaacggaagcttggttccggtgccgcccactactcctgcgccgggggtgcagctggacgtggaggcgctcatccccacgcacgatgagcagggccgtcccaagcccgagtggaagcgccaggtgatggtgggcaagatgcagctgaagatggaggaggaggaggagcagaggtggaaagaggaggaggaggcccggctggccagcatgcccgcctggaggtgggacctcctgcggaagaagctggaagaagagag

SEQ ID NO: 411825 - DNA, 1135 bp, Homo sapiens
gacaaagacaattctggtcccacagtcttgcatctgactgcccgctttggccaccccaaggtggtgaactggctcttgcatcatggcggtggggatcccaccgcggccacagacatgggcgccctgcctatccactacgctgcagccaaaggagacttcccctccctgaggcttctcgtcaggcactaccctgagggagtgaatgcccaaaccaagaacggtgccacgcccctgtacctggcgtgccaggagggccacctggaggtgacgcagtacctggtgcaggaatgcggcgcggacccgcacgcgcgcgcccacgacggcatgaccccactgcacgccgcggcgcagatgggccacagcccggtcatcgtgtggttggtgagctgcaccgacgtgagcctgtcggagcaggacaaagacggcgccaccgccacgcacttcgcggcgagccgcggccacagcaaggtgctcagctggctgctgctgcacggcggggagatctcggctgacctgtggggcgggaccgcgctgtacgacgccgccgagaacggggagctagagtgctgccagatcctggtagtgaacggcgcggagctggaagtccgcgaccgcgacgggtacgcggccgctgacctgtcggacttcaacggccacagccactgcacccactgcctgcgcacggtggagaacctggtacgatccctgcgctgctcctgttgcattctctcttctcgcccctccaccccagtggtgggtgtcgtcaccccttttaccaaggaggaagctgaggttcagagacgtgaagcccgctaccccacacgacctgtcagcccagaaccactgcctgctggggactgagggagtagaggcacaaaggttaacggaaagaggacagggaagaacagggtcaccccaaggggtaaggctggagaaatcacaagacaggccccattgggaacaggcaggctcattcacctacccatagacattagcttgggtataactcacagccaccctctgcagaagagagtgtaagtgtcccgttccacatatgggtaaagggagtctgcggggcaccaggatcgcatcaccagtaagtggtagagtggagaacctaccttgatggcctgac

SEQ ID NO: 411826 - DNA, 1509 bp, Homo sapiens
gacaaagacaattctggtcccacagtcttgcatctgactgcccgctttggccaccccaaggtggtgaactggctcttgcatcatggcggtggggatcccaccgcggccacagacatgggcgccctgcctatccactacgctgcagccaaaggagacttcccctccctgaggcttctcgtcaggcactaccctgagggagtgaatgcccaaaccaagaacggtgccacgcccctgtacctggcgtgccaggagggccacctggaggtgacgcagtacctggtgcaggaatgcggcgcggacccgcacgcgcgcgcccacgacggcatgaccccactgcacgccgcggcgcagatgggccacagcccggtcatcgtgtggttggtgagctgcaccgacgtgagcctgtcggagcaggacaaagacggcgccaccgccacgcacttcgcggcgagccgcggccacagcaaggtgctcagctggctgctgctgcacggcggggagatctcggctgacctgtggggcgggaccgcgctgtacgacgccgccgagaacggggagctagagtgctgccagatcctggtagtgaacggcgcggagctggaagtccgcgaccgcgacgggtacgcggccgctgacctgtcggacttcaacggccacagccactgcacccactgcctgcgcacggtggagaacctgagcatggagcactgcgtgctctcccgggatccatccgtggagctggaggcgaagcagccggattcaggcatgtcctcacccaacaccacggtgtcggtccagcctctgaactttgacctcagctcgcccaccagcaccctctccaactacgactcctgctcctccagccactccagcatcaagggccagcaccctccacgtgggctttccagcactagagctgcagacatacagagctacatggacatgctgaacccagagctgggcctgccttggggcacgattgggaagcccatacccccaccacccccacccagcttccccccgccacccccgcccccaggcacccaactgcccccacccccacctagctacccatctcccaagcctcctgtgggaccacaggcagctgacatctacatgcagaccaagaacaaactccgccacgtggagacagaggccctcaagaaggaggtagtgagccctcacccactgcctgcctcccagcaggggtactgggctgatgggggccagtcaggccaaaggcctggcctcactagtgggcacagggtgggggtccctgggtccatggcatattcaagagtcaaagctcctggcgagtcccacgaggggtcagggctggacactggactgggaggagagtaagagcaggtcactgccctccatgggagctggggggtgaaggacgcaggtccagacagctgttcctcaccaggaactgggcctgtgccacctcttgcacaggagtggccgggttgtcatggagttgacagagaatgcatggagactgcc

SEQ ID NO: 411827 - DNA, 693 bp, Homo sapiens
gtacaatgtcctactgtgattatttcaggaaaccagcaacatggggacagataaaagtaagaagcaggttaccttcgctctctggttttggaaccacacctggacgacacggacactcagccctgtctctgcagccagagtctctctcaccttggaaaaattgaacgagaaatgtagacacactggcatctcagggtaggaggtagaacatctcctatataatacatgaggaggccaaaagactgtatctgctttaggagctgaatagtttttaatgttgagcatacacacaaacacgagaacattgcttcccttcaggtagaaagaaagtccttcaccaggtaactttgggtgtttcatgaatatccatagtgactgctaccccaagtgagccctgcccaaagagaataaaatgagagccatctggaacccggcagagccaggaagtgtggccacaggactacattctggccaacacatatgaggagaaatgatttgagcaacccctggatacatccttaaaaagcagggcgcttgccctccatttcctctttctctacctggtgactggaaacatggtgacaactggagcagtcgcttggacacaggagatggataacagagccacccaccagccttgccttgctcacctctggactgtgacagaagagaataaactcctgtctcattaaa

SEQ ID NO: 411828 - DNA, 830 bp, Homo sapiens
ggcgggtcctgcgctgcgtcagggtgccgaggcggggtttctcgcctccggtcacaatgggacctctgtaccgcgctgggcttgttggcctgcgattagcacacacccatccctgggaactgctagtctggaaagcggggctgcttctccgggatgagcccgagccctgccaagcccctcaaggcattgaagctttagctcaccttatccgaatggtcattgggcatctggacttgagttaacgactgaatttttctgggaagcaagggacacgttctaaaataaccccaggatcactctccgaacttggcctgagtctaggcaagcagtgttactcggtcgccttgatcttggagctgctgtgtactggggacctcatactagttgggttaactatattcccattagcagtacgcgggatcgcagtactcgggacaagctgagttcaggtatttgggtaagacaactgcaacacttcagaggttatttgtggagtaagatgttcgaccatacagtgaataattcgaagctagggagaacagattagagtctggtatgaagaagaaagggaaggaaaggaatagttttgaagctcagcgctagaacgactcgatgtccatgccagggtaccccgagtgggccttgaaatcttgcgtctcagtgccttacagggaatggtagaaactggaaaatctacaagtaaagtattgggacctcctaattttccttttagatggaggaaaacgggctgggattccctgcagcacttagcacacggtgaatacgtttgttagtagtaaataaaacccttaactggactgagtttaatt

SEQ ID NO: 411829 - DNA, 644 bp, Homo sapiens
ggcgggtcctgcgctgcgtcagggtgccgaggcggggtttctcgcctccggtcacaatgggacctctgtaccgcgctgggcttgttggcctgcgattagcacacacccatccctgggaactgctagtctggaaagcggggctgcttctccgggatgagcccgagccctgccaagcccctcaaggcattgaagctttagctcaccttatccgaatggtcattgggcatctggacttgagttaacgactgaatttttctgggaagcaagggacacgttctaaaataaccccaggatcactctccgaacttggcctgagtctaggcaagcagtgttactcggtcgccttgatcttggagctgctgtgtactggggacctcatactagttgggttaactatattcccattagcagtacgcgggatcgcagtactcgggacaagctgagttcagctgctatgagtaacacgatctggaaagacagcgctagcaaggaatgaggagtgatacagtgactggaggctaagagataatgtctgcaagtcacctaaaaccattgcagacacagggagattgatggatttggaggacttctggttgtgaagactctgacgattgctaaagagttaagtgaaatactagcgtggt

SEQ ID NO: 411830 - DNA, 1538 bp, Homo sapiens
  misc_feature (891)..(891): n is a, c, g, or t
  misc_feature (896)..(896): n is a, c, g, or t
  misc_feature (900)..(900): n is a, c, g, or t
  misc_feature (910)..(910): n is a, c, g, or t
  misc_feature (926)..(927): n is a, c, g, or t
  misc_feature (929)..(929): n is a, c, g, or t
  misc_feature (950)..(950): n is a, c, g, or t
  misc_feature (958)..(958): n is a, c, g, or t
  misc_feature (971)..(971): n is a, c, g, or t
  misc_feature (976)..(977): n is a, c, g, or t
  misc_feature (989)..(990): n is a, c, g, or t
  misc_feature (997)..(998): n is a, c, g, or t
  misc_feature (1002)..(1002): n is a, c, g, or t
  misc_feature (1005)..(1005): n is a, c, g, or t
  misc_feature (1012)..(1013): n is a, c, g, or t
  misc_feature (1016)..(1016): n is a, c, g, or t
  misc_feature (1019)..(1019): n is a, c, g, or t
  misc_feature (1027)..(1027): n is a, c, g, or t
  misc_feature (1029)..(1029): n is a, c, g, or t
  misc_feature (1031)..(1031): n is a, c, g, or t
  misc_feature (1054)..(1054): n is a, c, g, or t
  misc_feature (1058)..(1058): n is a, c, g, or t
  misc_feature (1060)..(1060): n is a, c, g, or t
  misc_feature (1076)..(1076): n is a, c, g, or t
  misc_feature (1088)..(1088): n is a, c, g, or t
  misc_feature (1091)..(1092): n is a, c, g, or t
  misc_feature (1115)..(1117): n is a, c, g, or t
  misc_feature (1133)..(1133): n is a, c, g, or t
  misc_feature (1142)..(1142): n is a, c, g, or t
  misc_feature (1150)..(1150): n is a, c, g, or t
ggtcgccgcagtcacggagcgcacgtcgggaaacctctcagcctcatctgtaaaatgtgatcataaataccgggtacctggaagtgctcgagacagatctcactatgttgaccgggctggtctcaaactcctggcctcaagcagtcctcctgcagcaacttcacagcaacactggaatgacagaagaactccactgaacattcattgaaggcccagatttagagtgagcggggcaaaccaagttttgtgctgggtggaaggaggggcggctgctgttcagcccacaggattcctgtgaggacaccacatgttcatagttgttaaaccatcttgcaaactcattgcctgatgttcagatctcccggctcagctggtgtctgtggaggacaggatttatgtttcagagagggcatgagcccagatgatgcctcaagactcaggttctaggagagaaagcagtgcttcagggactttgactgcccccgcccgaaatgcagtcgccatctgcaggtaaacagagctggagctggtgctgccggaaaagaaagaggagggctctccggcagcctgcggcttcctcaaggacttcccaggccaggcgctgtggctcacgcctgtaatcccagcactttgggaggccgaggcgggcagatcatgaggtcaggagatcgagaccatcctggctaacacagtgaaaccccatctctactaaaaatacaaaaattagccaggcgtagtggcgggcgcctgtagtcccagctactcaggaggctgaggcaggagaatggcgtgaacccaggaggcggagcttgcagtgagccgagatcgcgccactgcactccagcctgggtgacagagcgagactccgtctcaaaaaaaaaaaaaaaaaanaactnccgnctgtaatccnagcactttgggaggcnnangcaggtggatcacctgaggtnaggagttngagaccagcctgnccaanntggtgaaacccnntctctannaaanttncaaaaannagntgngtgtggtngngngcgcctgtaatcccagctactcnggangntgaggcagagaatcgnttgaacccgggnggnngaggttgcagtgagctgagatcnnnccactgcactccagcntgaaagagngagactcnatctcaaaaaaaaaaaaagtttctggcacctgaacaggaactggtttccatcatcaactcagaaagcactaaaatctaggtggtgattcagggaggagcaggggaagacagcctcctatggtggcatgaataagatgcttccagaactagtagggaaataactaacctcttcaggctttatcaggcctggaggggaaccttgctcatgttagcaagaaaggtatcctagagaagccactcaaaaggctccctaatccagcctgtctccacatacatactgaaaattcttccctactctgaggcagggtgtagtggtttaggggtttctccagactggaatcctacctatctgtaccgacaattgagcaaacaacagttgagagagtcc

SEQ ID NO: 411831 - DNA, 534 bp, Homo sapiens
gtgcaatggcccgatctcggactcctgacctcatgatccgcgccacttggcctcccaaaatgctgggattacaggtgtgaaccactgcgcccggcccttaaaatcaatttctaaatgctcttgagtttatagcctttcatgctagctgtccctcccatcacccccccatctagaggctagacttaaagactgagattgttttccccaaatcccttaacctgatgccaatccatcccccataactaaatttctgcccgcctttttttttaaaatttttttttttttttttttctgtagagacagatctcactatgttgaccgggctggtctcaaactcctggcctcaagcagtcctcctgcagcaacttcacagcaacactggaatgacaggtgtgagccactgtggcaggccaatctcctggttgatttcaatctagacacatttaatgagcaccaaacatgagccaggcagtggactagactcaaggatgggttgaatgtgttcctgtccattcaagcagtacatcaaggcaa

SEQ ID NO: 411832 - DNA, 805 bp, Homo sapiens
ctaggtacgggccgggtgttaatcgggcgagcattcccaaaggccccacctgttcattctaccccattggtagaattcccattgggaattaggcttcaacatacaaatttgggagacactgacatttaggccatagcgcgtcaaaggcaaagtgaggctgagtgtggaaaccatcccagaatctggatgtggcccaggcagaaggaaactcaaagtgatggggtgaccgatggtccctggtctgtgcaggactcagcggtgcggatggccctgggcacggtggcagtggctgttggaggatgatagggaacatgttggtggggggagggtggagcccactatgagtggcaactccctgggggcacaggaaacaaagctagaggtggctcccctctcccctccctgcacacagtgtcacctctgtggtggccctgtcgtccgcctcagttcacaggtgttgctgtaacaactcctgaaattaccttcaaaaggaggctcgtgcaggtgcctgcaggagccaggaggccgaagtgcatcctgagtgtccggggacaggccagcctggcggggtccacggccccacagtcccaacgactgcctcagaaatgggcagagagcatgcctggttctagctggcaaggccacatctcagagctgtggacagtcatgaagggtccgtgagcatggagagggggcaaaaatgacccatgaacctcaggccactgtgctgcatccagccaagtgcggtaccagcccttcggcctcgagatcctctacccttctctgggccttgctgatttcctcc

SEQ ID NO: 411833 - DNA, 813 bp, Homo sapiens
tacgactaggtggaggctggagtaaatcggccgaggctgcattcccaaaggccccacctgttcattctaccccattggtagaattcccattgggaattaggcttcaacatacaaatttgggagacactgacatttaggccatagcgcgtcaaaggcaaagtgaggctgagtgtggaaaccatcccagaatctggatgtggcccaggcagaaggaaactcaaagtgatggggtgaccgatggtccctggtctgtgcaggactcagcggtgcggatggccctgggcacggtggcagtggctgttggaggatgatagggaacatgttggtggggggagggtggagcccactatgagtggcaactccctgggggcacaggaaacaaagctagaggtggctcccctctcccctccctgcacacagtgtcacctctgtggtggccctgtcgtccgcctcagttcacaggtgttgctgtaacaactcctgaaattaccttcaaaaggaggctcgtgcaggtgcctgcaggagccaggaggccgaagtgcatcctgagtgtccggggacaggccagcctggcggggtccacggccccacagtcccaacgactgcctcagaaatgggcagagagcatgcctggttctagctggcaaggccacatctcagagctgtggacagtcatgaagggtccgtgagcatggagagggggcaaaaatgacccatgaacctcaggccactgtgctgcatccagccaagtgcggtaccagcccttcggcctcgagatcctctacccttctctgggccttgctgatttcctcc

SEQ ID NO: 411834 - DNA, 829 bp, Homo sapiens
gcctgtttgatgagagcactaccttccttcaggaggggattattcagaaagtctgtctggtttcagggcgcattcccaaaggccccacctgttcattctaccccattgggaattaggcttcaacatacaaatttgggagacactgacatttaggccatagcgcgtcaaaggcaaagtgaggctgagtgtggaaaccatcccagaatctggatgtggcccaggcagaaggaaactcaaagtgatggggtgaccgatggtccctggtctgtgcaggactcagcggtgcggatggccctgggcacggtggcagtggctgttggaggatgatagggaacatgttggtggggggagggtggagcccactatgagtggcaactccctgggggcacaggaaacaaagctagaggtggctcccctctcccctccctgcacacagtgtcacctctgtggtggccctgtcgtccgcctcagttcacaggtgttgctgtaacaactcctgaaattaccttcaaaaggaggctcgtgcaggtgcctgcaggagccaggaggccgaagtgcatcctgagtgtccggggacaggccagcctggcggggtccacggccccacagtcccaacgactgcctcagaaatgggcagagagcatgcctggttctagctggcaaggccacatctcagagctgtggacagtcatgaagggtccgtgagcatggagagggggcaaaaatgacccatgaacctcaggccactgtgctgcatccagccaagtgcggtaccagcccttcggcctcgagatcctctacccttctctgggccttgctgatttcctcc

SEQ ID NO: 411835 - DNA, 442 bp, Homo sapiens
cctctgtggtggccctgtcgtccgcctcagttcacaggtgttgctgtaacaactcctgaaattaccttcaaaaggaggctcgtgcaggtgcctgcaggagccaggaggccgaagtgcatcctgagtgtccggggacaggccagcctggcggggtccacggccccacagtcccaacgactgcctcagaaatgggcagagagcatgcctggttctagctggcaaggccacatctcagagctgtggacagtcatgaagggtccgtgagcatggagagggggcaaaaatgacccatgaacctcaggccactgtgctgcatccagccaagtgcggtaccagcccttcggcctcgagatcctctacccttctctgggccttgctgatttcctcctccagcccctctgtttgtgtacgcacatacacacatgcacgcacgcacacgcac

SEQ ID NO: 411836 - DNA, 5330 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411837 - DNA, 657 bp, Homo sapiens
tttttttttatttgtgttttttttcctccgtatcctctacattgttgtagggactcagtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411838 - DNA, 676 bp, Homo sapiens
  misc_feature (16)..(17): n is a, c, g, or t
  misc_feature (20)..(20): n is a, c, g, or t
  misc_feature (40)..(40): n is a, c, g, or t
  misc_feature (44)..(44): n is a, c, g, or t
  misc_feature (47)..(48): n is a, c, g, or t
aagaaataaaaaaaanntanaataaaataaaaaaaaaatnaaanaannaaaaatttcagtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411839 - DNA, 653 bp, Homo sapiens
  misc_feature (43)..(43): n is a, c, g, or t
gtggcgcgggcatatattgatcgccacttagggccacgcccantatattcctagtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411840 - DNA, 652 bp, Homo sapiens
caccccacccgaaccagtcggcgactctcacaccacaacacaccaaaacctagtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411841 - DNA, 5363 bp, Homo sapiens
  misc_feature (5345)..(5345): n is a, c, g, or t
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccaaaaaaaaaaatcggnctcgttggcctcaagtgg

SEQ ID NO: 411842 - DNA, 5411 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411843 - DNA, 1071 bp, Homo sapiens
ccttctccctccagaagtcatggtgtcatccacactatcctttgtaaacagaggttcacacagataccatacacgcacacacacgcatggtgctgtgaccttgttttttctaacagtctggcctggagatcgttccttatccccaggcgtatgcctgccatcgtcatccgtttttcttggctgtgaaacatctcacagtctggtggactgcatgctttgtttaatgagtccccctcatgaggggccttcacagcgtggctgtagcccacctgacccacacagccctgtgcatgtgtccacttagaagtgggcaggctgggagccctggctcttttgcattagaatttccccccaaatgggctgggcatcaggctgtccccctgcctgcaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411844 - DNA, 5519 bp, Homo sapiens
  misc_feature (5519)..(5519): n is a, c, g, or t
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccaaaaaaaacaaatctggcctctctggcctcagagatggagctttagggccggttgcttttagtgagggaaattaaagatactgggtgactgaattctcttgactggacgttaggctggtttatgcggtgtcagctgcatccaaggctgatatgtggtttgtatccgatcatgtgatcctggtataaaaan

SEQ ID NO: 411845 - DNA, 5384 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccaagtcaaaacatttaattggtttatttgctgttaata

SEQ ID NO: 411846 - DNA, 5420 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagttaaaagagaaatgaaatagggaatagtcatgtaaaaagtgaattttaagtatcagagtgattaaaatccgccctctttggtctaagcgggggaactttggggccgtttcccttttagggggggttaatttatgattctagctcattgacttcgttaagtttgggagtttaggatgaggcgagggggtttcgcctacct

SEQ ID NO: 411847 - DNA, 5348 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411848 - DNA, 5457 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccaagtcaaaacatttaattggtttatttgctgttaata

SEQ ID NO: 411849 - DNA, 5414 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagccactgggcatcctgtccatcctggaggaggaatgcatgttccccaaggcctcagacgccagcttccgggccaagctctacgacaaccacgcggggaagtcacccaatttccagcagcctcggcctgacaagaagcgcaagtaccaggcccacttcgaggtggtccactacgcaggcgtggtgccttacagcattgtgggctggctggagaaaaacaaggatcccctgaatgagaccgtggtccccatcttccagaagtcacagaataggctcctggcgactctctatgagaattatgcgggctcctgctccactgagccccccaagtctggggtgaaagagaagcgtaagaaggcagcatcgttccagacggtgtcccagctgcacaaggagaacctcaacaagctgatgaccaacctgcgggccacacagccccacttcgtccgctgcattgtccccaacgagaacaaaaccccaggggtcatggatgccttcttggtgctacaccagctgcgctgcaatggggtcctggaggggatccggatctgccgccaagggttccccaacaggttgctctacaccgacttccggcagcggtaccgtatcctgaaccccagtgccatcccggatgacaccttcatggacagcaggaaggccacagagaaactgctgggctcgctggacttggatcacacccagtaccagtttggccacaccaaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctggagctgacactggccaaagctgagaaggagaagcaagccactgagaacaaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgactaaggccaagctccggctggagcaacaggtggaggacctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagaaggactccgagctgagccagctgagcctgcgggtggaagacgagcagctcttgggggcccagatgcagaagaagatcaaggagctgcaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggccagtgcagagaagctgtgccggacctatgaggatcagctaagcgaggccaagatcaaggtggaggagctgcagcggcagctggcggacgcaagcacgcagcgtgggcgactacagacggaaagcggggagctgagtcgcctgctagaggagaaggagtgtctgatcagtcagctgagccgtggaaaggccctggccgcccaaagcctggaagagttgcggcgccagctagaggaggaaagcaaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaaaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcaggaggagatcagcgacctcacagaccaggtgagtctcagtgggaagagcatccaggaactggagaaaaccaagaaggcgctggaaggcgagaagagtgagatccaggctgcactggaggaggcagagggggccctggagctggaggagaccaagacgctgcggatccagctggagctctcccaggtcaaagcagaagtggaccggaagctggcagagaaagacgaggagtgcgctaacctgaggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcagaacacaggcctcctaaaccagaagaagaagctggaggcggacttggcccagctgagcggggaggtggaggaggctgcacaggagaggcgggaggctgaggagaaggccaaaaaggccatcactgatgcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtacgggagctggaggctgagcttgatgcagagcagaagaagcacgccgaggcccttaagggcgtgcgcaagcatgagcgccgtgtcaaggagctcgcataccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggagcagcaggccaacaccaacctggccaagtatcgcaaggcccagcacgagctggatgatgcggaggagcgggcagacatggcggaaacccaggccaacaagctgcgggcacggacccgggacgccctgggccccaagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctcca

SEQ ID NO: 411850 - DNA, 1051 bp, Homo sapiens
agttcatccgcattcactttggtccctctgggaagctggcatccgcggatattgacagctatctcctggagaagtcgcgggtgatcttccagttgcctggtgagcgcagctaccatgtctactaccagatcctctcagggaggaagccagagctgcaggacatgctgcttctgtctatgaacccctatgactaccacttctgcagccagggcgtcatcaccgtggacaacatgaatgatggggaggagctcatcgccaccgaccatgccatggacatcctaggcttcagcgtggatgagaaatgtgcctgctataagatcgtgggcgccctcctgcactttggcaacatgaagttcaagcagaagcagcgggaggagcaggcggaggccgatggcactgagagtgctgacaaggctgcctacctgatgggggtcagcagtggggacctcctcaaaggccttttgcacccccgggtgcgtgtagggaacgagtacgtgaccaagggccagagtgtggagcaggtggtgtttgctgtgggggctctggccaaggccacctatgaccggctgttcaggtggctggtgtctcggatcaaccagaccctggacacaaagctgccccggcagttcttcatcggggttctggacatcgctgggtttgagatctttgagttcaacagcttcgaacagctgtgcatcaacttcaccaatgagaaattgcagcagttcttcaaccagcacatgtttgtgctggagcaggaggagtacaagcgggagggcatcgactgggtcttcatcgacttcggccttgacctgcagccttgcatcgacctcatcgagaagcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattatggataaaaaaaaaa

SEQ ID NO: 411851 - DNA, 529 bp, Homo sapiens
tggggtgaaagagaagcgtaagaaggcagcatcgttccagacggtgtcccagctgcacaaggtaaggccccatctgggagacagaccctccctcttggcagcctccagccccgtccttcaccccctgccctgtcccctgtgccttgggcgggcggctgttaagacttgcagtgatgtttaactcctctccacgtgaacatcacagcaagtctgtgctgcttcccgtccctacgctgcctgggcagggtttgtggggaaggggtgggagccctggggctctgggagggacggggatttggcagggaagtgaagactttggtggtggtgatgggagacagcgaagggtctcccatcaccagaatgagagtgaaagagcaaaagtgcagggcacttagggccctgctcccgtctcggtcctgaccactgcggcatccaattctggttctctgccccctttgtgcctttccctcactcttccccactgccaggagaacctcaacaagctgatgaccaacctgcgggccacaca

SEQ ID NO: 411852 - DNA, 178 bp, Homo sapiens
ggggtgccctggtggggccaccctggaatcaggggtgagtggagtgacctgggtgggagtacaagccatgggggtggcctctcagcaccctgtccactgcagaggagatcagcgacctcacagaccaggtgagtctcagtgggaagagcatccaggaactggagaaaaccaagaaggc

SEQ ID NO: 411853 - DNA, 4544 bp, Homo sapiens
acagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagtgatataaaatttttcttgaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 411854 - DNA, 4439 bp, Homo sapiens
acagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgtctggaaagatggctgaataggaacagctctgctctgcagctcccagcgagatcaacgcagaaggagataatttctgcatttccaactaaagtacccagctcatctcattgggactggttagacagtgggtgcagcccacagaaggcaagcagaagcagggtggggtgtcgcctcacccgggaagcgcaaggggtcagggaactccctcccctagccaagggaagctgtgagggactgtgccgtgaggaacggggcattccggcacagatactatgctttccccacggtctttgcaacccacagaccaggagattcccttgggtgcctgcaccaccagggccctgggtttcaagcaaaaaactgggcagccatttgggcagacactgagctagcagcaggagtttttttcataccctagtagcccctagaatgccagcgagacagaactgttcactcccctggaaaggggcactgaagccagggagccaagtggtctagctcagcagatcccacccccacggagcccaacaagctaagacccactgggttgaaattctcgctgccagcacagcagtctgatgtccacctggaatgcttgagcttggtgcagggaggggcgtctgccattactgaggcttgattaggcagtttccccctcacagtgtaaacaaagctgctgggaagtttgaactgggtggagcccactgcagctcggcaaagttgctgtagcaagagtgtctctctagattcctcctctctgagcagggcatctctgaaacaaaggcagcagccccagtcagggacttatagataaaactcccatctccctgggacagagcacctgggggaaggggcagctgtgggcacagcttcaggacacttaaacgttcctgcctgctggctctgaagagagcagcagatctcccagcacagtgctcaagttctgctaagggacagactgcctcctcaagtgggtccctgacccctgtgcctccggagtgggagagaccttccagcaggggtcaacagacatctggtgggtgcccgtctgagacgaagcttccagaggaaggaacaggcagcaatctgtgctgttctgtagcctgcgctggtgatacccaggtaaacagggtctggagtggatctccaacaaactccagcagacctgcagcagaggggcctgactgttataaggaaaactaacaaacagaaaggaatagcgtcaacatcaacaaaaaggacatccacacaaaaaccccatccgaaggtcaccagcatcaaagaccaaaggtagataaatccatgaagatgaggaaaaaccagtgcaaaaaggctgaaaattccaaaaaccagaacaccttttctcctgcaaaggatcacaactccttgccagcaagagaacaaaactggatggagaatgagtttgacgaatttacagaaggaggcttcagaaggtgggtaataacaaactcctctgagctaaaggagcatgttctaacccaatgcaaggaagctaaaaatgaaaaaaggctggaggaattgctaactagaataaccactttagagaagaacataaatgatctgatggagctgaaaaacacagcacgagaccttcgtgaagcatacagaagtatcaatagctgaatcgatcaagcagaagaaaggatatcagagattgaagatcaacttaatgacataaagtgtgacgtcaagattagagaaaaaaagaatgaaaaggaacgaacaaagcctccaagaaatatgggactatgtgaaaagaccaaacctatgtttaattgatgtacctgaaagtgctggggagaatagaaccaagtttgaaaacactcttaggatattatccaggagaacttccccaacctagcaagacaggccaatattcaaatcagtaaatacagagaacaccacaaagatactcctcgagaagagcaaccccaagacacataatcatcagattcaccaaggatgaaatgaagaaaaaaatgttaagggcagccagagagaaaggtcggtttactcacaaagggaagcccattaaactaatagcagatttgtctgctgaaaccctacaagccagaatagagtggggggccaatatttaacattcttaaagaaaagaattttcagcccagaatttcatatccagccaaactaagcttcattagcaaagaagaaataaaatcctgagagacaagcaaatgctgagcgattttgtcaccaccaggcctgccttacaagagctccagaaggcagcactaaacacataaaggaaaaaccagtaccagccactgcaaaaacataacaaactataaagaccaccgacactatgaagaaactgcatcaactaacaggcaaaataaccaactagcatcataatgacaggatcagattaacacataacaatattaaccttaaatgcaaacgggctaaatgccacaattaaaagacacagactggcaaattggatagagtcaaaatccatcattgtgctgtattcaggagacccatctcacgtgcaaagacacacataggctcaaaataaagggatggaggaatatttaccaagcaaatggaaaggaaaagaaaaaaagcaggggttgcaatcctagtctctcataaaacagactttaaaccaacaaagataaaaaaagacaaagaagggcattacataatggtaaagggatgaatgcaacaagcagagctaactattctacatatatatgcacccaatacaggagcacccagattcataaagcaagttcttagagacctacaaagagacttagactctcacacaataataatgggagactttgacactccactgtcaatattagacagaacaatgagacagaaaattaacaagaatattcaggacttaaactcagctctggaccaagcagacctacagaactcagaacttgaactcagctttggaccaagcagacatctacacaactctccacttcaaatcaacagaatatacattcttagcagcaccacatcgcacttattctaaaattgaccacataattggaagtaaaacactacacaccgaatgcaaaagaacggaaatcacaacagtctctcagaccacagtgcaatcaaattagaactc

SEQ ID NO: 411855 - DNA, 1670 bp, Homo sapiens
acagactgttagtgcacatcaatatccattttgtcctcttcttttttggcatacaaccaaaacttacataggctttttatcattttactgggcctatgtaactgagttttagccagtggaatatgtccaagtgacatttgccacttctaggtctggcacattaacacttgatgtattacatttcagaccctcttatcattctgcagtgtgtttggcgatctgttgtttaagatctatatgcactggttactgttgcttgccttccattcctacccttactaatcagattcctattatagctacttctgtccttgattcattttgtatattagatgtgtgtgtgttcatgtgcatgcatgcaccctcacatgtaggtgtatatgggagtggtggtaaagacaggatatttcttcagttcatgggattttatttcaggagaattcaaacattcacgtattggagaagatgacacatttcttgaatgtctttggctttgagctgaatgcactaactagaagggacttcagattgtcctccttcgggggaggtaagtatattcttcatatacaggtaagagtgaaatgatagaagaatgttcctcctctccttttcttcctggacaacagatcaaatatttctcagatcttttacagctgaattggagtcacatggacaggtatgatcttaaaatataaaaaattattttaaaattacatgctaaaattttataaaaataaatgctaaaactaacttaaacggaagcatttgattaaaaaatttatccaaaaaagtttgaattttatatgaaacaggatagaagatgaaaaagctaaagaaataaaatataaataaattatggctggggacagtggctcacacctgtaatcccagcactttgggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcagagttaaaagaagccaggtgtggtggctcacacctgtaatccctggactttgggaggctgaggccagagaatcacctgaggtcaagggtttgaaaccagcgtggccaacatgacaaaaacccatctctactaaaatagaaaaattagccaggagtgatggcgggcacctgtaatcccagctacttgggaggctgatggaggagaatcacctgaacccaggaggtggaggttgcagtgggccaagattgcaccactgcactcctgtctgggcaacagagtgagactgtc

SEQ ID NO: 411856 - DNA, 819 bp, Homo sapiens
ggaggctgaggtgggaggactgattgaggctaggagtttgagacctgttatttgaggcacatgggaaggaaagttttctttgagatattccacattttataatattcttcaagagatttacagagttccttgagtgaattgttggtttgttcttaatactgaatttcctattcaaatttatttagaagttcatttcttacagtgatctcatctcctattaagatattcttcaaggtaggttcttggccagtttctcaatgacagatttttaaaaatattgttaatctttttattaatatgagaacataattgttccagatctggaggccatcctttaagcttcttgcaacagtctgggagcaaagagtttactcgccactgggtagtgggccatggacaccccagtctccaccagaagttcgggattgcaaaatgggactctggcagcaaatttcaaactgtatgccagacctggccctttgcaggtgggcatcactaaaaatttaaattaccaaaattgactcaagagtaaatctatgtctgaggagaaagcctttggaaaaattgaattagtaagcaaaaacctacccaaaataaataacagtaagtctagaaaattttacacagggattaccaacaaacattcaaagcacagaaaaatctctttagcacaaaatgctacaaaatacagaaaaagaggaaaattctgtagtttctctcatgaagttaatatattctagttagctgaactagaaaaataagagaaagaaaaattataggttaatcttccttatgagtacatgcaagtatcataagatg

SEQ ID NO: 411857 - DNA, 276 bp, Homo sapiens
tgcctccttttagcacctgatttccacctataatactgtaattcaataacttgtgtgatatatgagaaatcctgaagttcatcacactgtaactgaattgccattcccacaacactccagagagttctcttgtcctcttttggccatgtgaggatacaagaagatggcagtctgcaaccaagacggctctcaccagaacccaaccatgctggtaatctgatctcagacttccagctccagagctgtaagaaataaatttctgtcgtttataagcca

SEQ ID NO: 411858 - DNA, 624 bp, Homo sapiens
ctcaactatccctttccccgagatcctgcaacattcaggcttaacagaagtgtcatttcctatctcaagctttggaagctctgagtttgcagaccacaaagatttgatagtattttcagtgtttctccatgataaggtcacacacacacacctctatatccaacgcttgtatgtcccacatgtgtttccaaattcctcatcggccttagagacacaaagagtttctggcttccctgcacctcagcgccaagtttctgtaagccacttccatgtaaaactctccttccgcttttaaaaagaaaactacattcggaaagggaagatacccaagaagaaaatcgagacggtaagtgcagcacttttataaagtaaacaaacaaaaagactgccctgacgaaggtggctgcaaaactctggggccggcgcgcacaacccacatcgcacacccccccagcgccgtgtgacgcccccagccccgttagcagaacggactcggcaccccaacctttctcggagggaaaatgcacgagtcagggccgcgctccccgccgccctggcacacagaatgtctccgggaatcgcccacacgagcccggggccgccctctccttccggcggcggccg

SEQ ID NO: 411859 - DNA, 1911 bp, Homo sapiens
  misc_feature (1142)..(1142): n is a, c, g, or t
  misc_feature (1432)..(1432): n is a, c, g, or t
aaccaggagtcggttgggctgagaccctgagccccaactgtcagaaggagcctgaggctgaggtggaggctgggagtttggggctgtgggtggatcctctgaaggccatggaatcctccacggggcccaggatgcctttgctcaaatactgcagcgtggccacaagcctgaaggcccctggctgggacggtgctgctccaccttgggacctctccttcacctacccctttgccctccaagcaccctggctcaccgggcacaagccccttgcaaggcatgcctcttcttgcccatgtctccacgttgccgacccagcatggcaggggcctggctggctgggaagagctggagatgctgccaacacatgggtcctagcaagaagggaagcagatggtttttactaccgggcccaaataaaggccactcccgagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagagcatcaaaggaaaaagaaatcactgttcatttctggaatggcaaagctgctaaagtgcccctaggtggggtccagtcggtgtccctgaccatctggaagaaggctgtggagaggctgcacaagtctttcaccagggagcaccccaggccccttcactgggccccttgctgctctctgctagggccaatcactgggcgcatcactaatgagcttcctccggatgctccattcctgtgccctctctgccaccatcatgcctgctgccagctactgtgccagggctgcctctgtggctgcccgccatgtggcacgacttggtggcctctaaccaggacctcagaagtcatggccagagaacttccagagttggagcccacagcacagcttttgcccctggaaggtcctaaagaggagaaagtagcaatgcacgctcccctggctgtttcttcctcctcatcctcctcctgtgaacaaganggtgtggagaatgatctggagatgggccctccccagagactgatggtgaacagtgcagtcaacacagatcccatctttcttgagatgcctctgagacagagtggcctctgccagcctgagtggaggtattggaagagaaacgggcctgagccatgccctgggaagccaggaacaagatattccaacatctgcaaagaagaaaaggatcacaaacagcagagagcacaaactgtagtagtggggactaccaaggagctggtctcgaaagcaacccacatgaagccaccgcngaccccgccaggggaagctgaacacagaaagcggagtcagagccttgcaatatgtcagtggaacaagaattcccgttagactaagagccctgaggatctaggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttcaaat

SEQ ID NO: 411860 - DNA, 468 bp, Homo sapiens
cacaatcaatgactttttaaaatcagtgacttttgattcttaaaattgcagtcagcataacaatgtatggaatttttcccccttttataggtaaagaataaacatggtaaatattcgaggagagttatacagagtggctgacaaggccttcttcaacggaaggaggcagaggacaggccacaggtaacagtcaaataaccaccagtatctccaccccacgaagacctccctgcagataagcagcaggaaggcacctgttgtgagggctataggaatgtgggatcctgccctggggctccctgccagggccctggtgaaactgctttaagatgcctcttccgtggaagagggggtcagcctgctttgggcaaatgtgtccacagccactctgccaccttcccataaagcctagttgtacatgagtgacattttgtttcacctcttaataaaaatgaattctcttcaaat

SEQ ID NO: 411861 - DNA, 509 bp, Homo sapiens
attctgagtgttttctttcccacagctggagagacagggggtcctgcttgtggaattcgaggctcctcttgtcgcaggcccaaagctgccagcccagcagcagagagtggtcttagaagaggatgtcattcctctctcaccatctgtaggatactcactgagaccaggggataaggtgctggcactctgggagccaggccaacagcagtatggccctggcactgttcttttgggcttggagatgagagatccccagagaggtaagagaagctgctctgacccatcagtgcccagaaggagccaggctgtaatcaggccagaggagagagccaaggctgcgtctacagcttaggggtttctaaggcattaagaagagaatttttcccccttgcttgctgcttaatcttgagggcagcaacagatgcctcaagatgcacagtgtatctttcagattattaaaaaaaaaattgtaatcagggtaaatggcctaaaactctcatatctatgtt

SEQ ID NO: 411862 - DNA, 367 bp, Homo sapiens
gactgtgggtgccaagtctgggcagggcctttgcccttgggagtcctgttttagacccagctccaccacgtggccctggcctcttctctgccctgtctgtgcttgcagccatggtgcccagtctggccccaccaggagacaccagaacgactgtccatgtgtctactccttggcaccttccccgcatgattggagaggacgaaggccctgaggtccaagaacattgaaacctgacagtggatgccaatggctgtggggaggagctgggcgaggcgcccaggttgtcgtctgcccggcaacgtgggagcctgcagcactttcctgcaaagctctattttatctttttaaataaaaatggttactgata

SEQ ID NO: 411863 - DNA, 561 bp, Homo sapiens
ggaggttatcagggttgattagatggtggcaggaatggcattctaagctgaagaaacattttcaaaagctagtaagcaagagagtgtgacaaagtcaaagagttttcagacattctgtaggttggagtttttgggttttcatacatagaggaaggaggtatcatcatatgacaggagaaggaagcagcaccttgacattaaaatgatcttgtatgtaacctttgaattagagaatatttcttacttggttcttatcaataaaattgcagaatttgatgaaatgaccatatagccccttgcagttctaataattaccaaagtctacaattcctatcctctccattgtcaatttcttgcagaatttatgcttgggtcttttaaatctaactgttcacttgccattcttattacagaatccctaatcagttgatgtaaatagttgacttaaatttaatgccatcatttttagtagggataatatccctgtaagtagacaatcttgaaattctgatgatttttgtatttttgtcaaatatctggtaattaaatatgttttcattt

SEQ ID NO: 411864 - DNA, 998 bp, Homo sapiens
tcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcatgcctgtaatcccagcactttgggaggccaaggtgggaggatcgtttgagcccaggagttgaagaccagcctgggcaacacagtgagacttcatttctacaaaaattaaaaaataatgttgttaattagccgggcatggtggcatgtgcctgtaatcccagctatttgggaggctgaggcaggagacttgcttaaacccaggaggcggaggttgcagtgagctgagatcacaccacagtactccagcctgggcaacacagcgagactcaatctcaaaaaaaaaaaaaaaaaaaaaaaaaagactgttaaagctgtagtaggctgggcgtggtggctcatgcccataatcccaacactttgggaagccgaggcaggtggatcaactgaggtcaggagttcaagaccagcctggccaaaatggcaaaaccccctctctactaaaactacaaaaattagccgggcatggtggctcatgcctataatcccagctactccggaggctgaggcaggagaatcgcttgaacccaggaggcagaggttgcagtgagccgagatcacaccactgcactccagtctgggcaacagagcgagattccatctcaaaaaaaaaaaaatgttgttaaagctataatcgttctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaa

SEQ ID NO: 411865 - DNA, 283 bp, Homo sapiens
taattttctctgggaccatggcaagtgcggcaagttcttagagcaacactggctgccatgatccagggttctgtgcatgtggctttggcaaagtaagtggtggcacctaatgttcagcagaaatggcgtcctcactgccccagctctgtggagtatgaccaaggaacaaagggtgatgttccagttgcctactctccaagcctaattctctaggcctcctggtgatactgaactccctgttatccttttaataaaatacttttctttttctgtcaaaattgga

SEQ ID NO: 411866 - DNA, 495 bp, Homo sapiens
caaaaattaaatagaattcatatatttgaaatccttggcatcaattcactccaggaatccaagacagtactcaactgaaggggaagcaagcacaagggagatttctgggacactgatactgttccgtttcttcatctgaatgctgcttatgggccttgttcaatttgtgaaaattcatgactttgtacatttatgttaatttcccagacaccctacagttaggggtgacttatgactgaattgacagccaatgcaacagaagacttggtccatgaaaacctcccatgcaatatcccttccatgctcttttctacctgctggattgatcgagctgagcatgcaaccttgaaaaaaaaagccttcaggagggtagagtcacaagatggaaggagcatacatcattacttgcagagggccactggctaactgggaacctttttgggactgtatgggaccaagaaataaatttatttcctatttgaaccgttaaacatt

SEQ ID NO: 411867 - DNA, 667 bp, Homo sapiens
cctcccaagtagctgggaccataggcacacaccaccatgcctggctattttttttgtatttttggtagagatggggtttcaccatgttacccaggctagtctcaaaccgcctgccttggcctcccaaagtactgggattacaggtgtgagccaccgcacctggctatattttcaacaaaagcattataaggaaactgcctagaaactacattttgaaaatcacagcacagtagaaaaaagggggcaccaatttaaaagaggacatggacatctactacttcattttctcttactcatctgtttgtctatttgcctctttaaagatattaactatatgtaagataaatattcagtgccttctgtgtgctagaggtgaggatgtgaggatgaatctggtatctgcctatatcagagaatggctatctagttactaaacccatttcctctattttgctgggcatacagttaatttcccagacaccctacagttaggggtgacttatgactgaattgacagccaatgcaacagaagacttggtccatgaaaacctcccatgcaatatcccttccatgctcttttctacctgctggattgatcgagctgagcatgcaaccttgaaaaaaaaagccttcaggagggtagagtcacaagatggaaggagcatac

SEQ ID NO: 411868 - DNA, 621 bp, Homo sapiens
ccctcaggcccagcagaagtcctctctgtcttctccaggcgcagcccttcagccatgcaatcctgcgtgtcctcgttcttcattccacaaatacgttctaagggcctcctgcatttcaggcacttcagaggaccttctggaagcttcccagggcctgctatcttccctgtactgtaaggggacactttgctcaactgttcacttgaacagagtcttcaatgtcttctagtgaattctgggctgaaaccaatgtcgacttggccaaattaaggccacggtcttggtcagccaccttccaggttgacttgccagggtgtcctgggttggtttgttttacagaagcagagctcccagggctcatcgcacagccatggccgaggtgtcgggactcaaattccgggcccttggctgtgcttctcacattctttccattgtccgacgcactgaggcagagacaggaattttaactactcaaaaactactgtttacgtattttactttgacttctttctgggttcttgcataggcttcaaggagggaggatatggatgtgagcttattgtacaaatgccctgggttttccaaacgtgtctgatcttaaatacacagccctgcgtgctg

SEQ ID NO: 411869 - DNA, 443 bp, Homo sapiens
gggaaaaaaaaaaaattctgccacaaaagccacattcaatagaaaacatttttttaaaaaaatagctaggcatggtggcatgcacctgtagtcccagctacacagcaggccaaggcgggaggattgcttgagcacaagagtttgaggttacagtaagcaatgatcagctactgcattcccacctgggcaacatctctaaagaaaaatcaaacaaaaaacgacatacagaaagtatgcgctatctgatttcaaccccaagtttgtcctgctttaccaggctttctcctggggcctggaggcagtggggccaagggcaggggtggggtgtgcaggggacagcagtgctccagcaataagagttcttgaagagtacttcatgagggggtatacaccaatagaggggaagccaccagccaccaacatagtgagatcccctctttagg

SEQ ID NO: 411870 - DNA, 862 bp, Homo sapiens
gggaaaaaaaaaaaattctgccacaaaagccacattcaatagaaaacatttttttaaaaaaatagctaggcatggtggcatgcacctgtagtcccagctacacagcaggccaaggcgggaggattgcttgagcacaagagtttgaggttacagtaagcaatgatcagctactgcattcccacctgggcaacatctctaaagaaaaatcaaacaaaaaacgacatacagaaagtatgcgctatctgatttcaaccccaagtttgtcctgctttaccaggctttctcctggggcctggaggcagtggggccaagggcaggggtggggtgtgcaggggacagcagtgctccagcaataagagttcttgaagagtacttcatgagggggtatacaccaatagaggggaagccaccagccaccaacatgcagaggaaaacaacaacaacaacaaaaacagaccccaaggtatcaggagaaggacagtctgaagtcatctggcacccagccattttggaagaactgatgcttctccacgggccttgttcccgtggtcaccccacccccaagatatcttgtgacaggctcctccagtaaccagaggcaggtgagcgctgctctgatcaacaaacacaccgcatgtggtctccagctgcaataaacaagtggctgtgcacagccaatgtcctgtgtggtgaaggtgagaagagtgagggggagccaagctgcaaccctcagcctgaatgtggttggaattatgagagcagttgtcaaagttagtaccttgacatagtgcaatgtgcattaaagtgcacagtgcaagtgacagaagacgggtggggataccagggtacgatcctctagatg

SEQ ID NO: 411871 - DNA, 687 bp, Homo sapiens
agttcctgaactggcgaagctcacccaggaggctctgccttcatcttgggtgtgaggtttgctccggaggtgcatggctgtggccggcatttcattcattcatgtcattcatttatttatttgagatggagtcttgctgtgtcgcccaggctggagtgcagtggcacgatctcggctcactgcagcctccgcccacacagattcaaggggtatacaccaatagaggggaagccaccagccaccaacatgcagaggaaaacaacaacaacaacaaaaacagaccccaaggtatcaggagaaggacagtctgaagtcatctggcacccagccattttggaagaactgatgcttctccacgggccttgttcccgtggtcaccccacccccaagatatcttgtgacaggctcctccagtaaccagaggcaggtgagcgctgctctgatcaacaaacacaccgcatgtggtctccagctgcaataaacaagtggctgtgcacagccaatgtcctgtgtggtgaaggtgagaagagtgagggggagccaagctgcaaccctcagcctgaatgtggttggaattatgagagcagttgtcaaagttagtaccttgacatagtgcaatgtgcattaaagtgcacagtgcaagtgacagaagacgggtggggataccagggtacgatcctctagatg

SEQ ID NO: 411872 - DNA, 570 bp, Homo sapiens
aggccagtgactgagaaaaataaaattcccaggatgctatttccagacttgtgtattcaaaaaaataacaaaacggatccactttaataagcccatcaaggtctttttttctttgaaaaaggaaattaattttaatgaatgatgttaaagtatagcactaatcagatgaataatggctggaaaaattaagaagtggtctgatgggtcaaagcagtacaagagttcactgccacaaaggaaagcataacactcccattcctaatgaggtaaaaaagctaacctgaataaaaagagctccatcaagatatgaaggggaactgggagatcatctaggtcatatccttcattttatggaatgaggaaacagagctctccagaaattacacaacttgcccagggtcacccagattgatgttggtggcaaaaccagcaccaagatacacactatccctggaccccagtctaaggcttattccaccagcctgcctgacccttgtactaagcaggaggtctcctccagaaaatagtacaccatctgggactcaatcaaaatggtctgtcttaataaaa

SEQ ID NO: 411873 - DNA, 450 bp, Homo sapiens
aggccagtgactgagaaaaataaaattcccaggatgctatttccagacttgtgtattcaaaaaaataacaaaacggtctgatgggtcaaagcagtacaagagttcactgccacaaaggaaagcataacactcccattcctaatgaggtaaaaaagctaacctgaataaaaagagctccatcaagatatgaaggggaactgggagatcatctaggtcatatccttcattttatggaatgaggaaacagagctctccagaaattacacaacttgcccagggtcacccagattgatgttggtggcaaaaccagcaccaagatacacactatccctggaccccagtctaaggcttattccaccagcctgcctgacccttgtactaagcaggaggtctcctccagaaaatagtacaccatctgggactcaatcaaaatggtctgtcttaataaaa

SEQ ID NO: 411874 - DNA, 319 bp, Homo sapiens
  misc_feature (45)..(45): n is a, c, g, or t
  misc_feature (52)..(52): n is a, c, g, or t
cataataataataaacgttaacacacacggcgcaacgcctcctcncttctantatatgaaggggaactgggagatcatctaggtcatatccttcattttatggaatgaggaaacagagctctccagaaattacacaacttgcccagggtcacccagattgatgttggtggcaaaaccagcaccaagatacacactatccctggaccccagtctaaggcttattccaccagcctgcctgacccttgtactaagcaggaggtctcctccagaaaatagtacaccatctgggactcaatcaaaatggtctgtcttaataaaa

SEQ ID NO: 411875 - DNA, 422 bp, Homo sapiens
gtagagaatttgctgaacgaaggaagatgcaggaagagaggccttggtcttgagtggggcaatcagcaagctgaagacttcttctactcatctattgacattcattggtgtggcatcggctcctgcaaagacctcataaactggttttaggccaacaggagacaaagttccccgtactaaaagggtacaacccttggttttcacagggatcagttctttgctctttgaaacgagatgatccgtctcacactgaaagtttcctatcgtgaggttcagtgtcatctagagtcaacggatgaagtataagtgttcactgtggaatttctacaacacaaaaagaagaggctggataaagaagataaactgaatattgaaactgttccttttccattaaaaaatagcaaaaaaagttttccctgtaa

SEQ ID NO: 411876 - DNA, 462 bp, Homo sapiens
  misc_feature (24)..(24): n is a, c, g, or t
cctgcaagaggaggcaagggtgtnaggaagataataaagatcctggaggcaggagtctcgctctgtcgcccaggctggagcgcagtggtgcgatctcggctcactgcaagctctgcctcctgggttcatgccattctcctgcctcagcctcctgagtagctgggactacaggccccagatgaatctttgtacaacaaagttgagaatcatagccctggcgttcagaagacaggaaatggtttctctggatcagttctttgctctttgaaacgagatgatccgtctcacactgaaagtttcctatcgtgaggttcagtgtcatctagagtcaacggatgaagtataagtgttcactgtggaatttctacaacacaaaaagaagaggctggataaagaagataaactgaatattgaaactgttccttttccattaaaaaatagcaaaaaaagttttccctgtaa

SEQ ID NO: 411877 - DNA, 352 bp, Homo sapiens
ggggaagttaggtttgcatctagaaagagatctagtccgagcgtggagaaggcagaaccaaacccacatggttgagacccacatctcagttcagcagttccagagatcctgcaagccctagagcctttgcaggcagggatcagttctttgctctttgaaacgagatgatccgtctcacactgaaagtttcctatcgtgaggttcagtgtcatctagagtcaacggatgaagtataagtgttcactgtggaatttctacaacacaaaaagaagaggctggataaagaagataaactgaatattgaaactgttccttttccattaaaaaatagcaaaaaaagttttccctgtaa

SEQ ID NO: 411878 - DNA, 441 bp, Homo sapiens
tgcttcttcttatctcccagaaacagtagacttttgcttgggttcatggacccagatgcttttttgccacagaaaattaagggttttgattcttaggagagaagcaaatgttcatgttcaatttttttcttatttattttttgctttgttttcttatttcagtaatgagttgaatatgatcattattttccacttacgccgcttgcaactctaatattttgtttttgttagcccccctttgacagttcagcactaaatcaaatgcagatgatcatcagttgtgtgaataaagtgtttttattgagaacaaaattgttgatatagacataaattaggatattatcctacttagcacaatatgtcactggctcaaaatgtaaaatcctctttaggctcaacaaagaatggtttttgaaactattgtctgtttttgacaaataa

SEQ ID NO: 411879 - DNA, 389 bp, Homo sapiens
agctagcctgagctcattcatatggtggttgcaggggtctgagatagcaatggaactatgcaaagccttatgaagactaggatagcaattggtacacagtcacttctgcagcattctactggacaaaataaatcacaatgctaattcgtgttcaaagctgatcacaatggctaaaagaaaaatgctaacaaaattacccaaccaatatgttcacttggtttttttttgtacctggtaagagatttttctcttatattcttgtgcaactcttactcatccttcaagtctcagttcatgcaccgcctcctctgggaatctggcctgtcctttcttccagcagactgaaccacagtatttttttgcgggggagaggaagatagtgtcttact

SEQ ID NO: 411880 - DNA, 374 bp, Homo sapiens
gtagggtgaaaatgatgcaaaaactttcaagactgggttgtagatggctgtaagagtcccacatggttcactggaacactgggtaaggagtccaaccatcctgaggccactacggtggagagaccacacgtagagagagaaagagaaagagaaatgactcatgagccccctgcccccaactcaaataatgccaaccctggtggtagacctctgagtgaagaaacttccagaagattccacctcccagccttcagtcttccagttgatgccccaaataccacagagcagagacaagccattcctactgtcacctgtccaaattcctgagccattggctttattaaatgattgctgttttaaaacatgaagtttga

SEQ ID NO: 411881 - DNA, 386 bp, Homo sapiens
cttttcttgaaagcaaatctgccctggtgtgagcgggccaatgtgggtcctaacttgcagaccatcttacctctgtatctgttagaaagcatctcatcagagctggttgttgtaagctagtttcctttgcctcatctcatgagtcactcatttgatgtttttaaaagtgataccaagtagatttctttcagaattggttactgcaaccgtatcacctcattagtaaagcaagcctcaataggaggtcagccatgtgaatctttaaagaaggtgggcagcatggagcaccttgttctctagtaggctccctgctgtaggcaggggaaccagaattagtcctacctcaggatttagcattgtctttctagtctcatcctgcttaactt

SEQ ID NO: 411882 - DNA, 485 bp, Homo sapiens
ccgtgagtgaagaagctgggatttctcctggtctctctgaccctggaacacgtggcctctgggtgtgcccagtaagagacgttaaagaagggcctcccccatgagccctgactgaggcggggcgctaggcaccccatcgatgtgcttcgtggttcacaggggagaggcagagggcctgtcggggggcagcgatggggcagccagagggggcggtcctggcctgtgtgagcctccttgaggggagggtgccaggaactaccccatgatcttctattctcatgtaagccacaagaccccaacccagatccccacagcaaaggcgaagtcaccaactcaacaaggcgcgtggccaggcgtggggctcacgcctgcaatcccagcaccatgggaggctgagcaggaggatggctcgaagccaggagttcgaaaccagcctgtgcaacacagcgagaccgctctacaaaaataaaaaaaaatcagctggg

SEQ ID NO: 411883 - DNA, 2310 bp, Homo sapiens
agcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggggta

SEQ ID NO: 411884 - DNA, 2289 bp, Homo sapiens
  misc_feature (795)..(795): n is a, c, g, or t
  misc_feature (863)..(863): n is a, c, g, or t
  misc_feature (1010)..(1010): n is a, c, g, or t
acagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggaggagaaggctggacgctgaggtgtctctcagctcccaaaccaacagccaccccgccccaccccttcctcttattctttactcccttctcaccctgcccagggcctggccaggcctcacccacaactttccctccaccccatcctctgtggccacctgaccccggcccgtgggagctacagcagggagtgcagcagacacatggccaacccagggaccccactgcagggcctcatgccccccgcctgccctcngctctctctgtgtgggcagcgctcaccagcctccctgggtgccgtccacctgggctcggctgctaagngctgtgagaggcttgttcagcctgggaggactcagggcggctgggatgagtcgtgtggaagggcggtcagagtgcgatggtcctaacccgaggcaccagcccctccttccccgtccccctgtgccttcctccagccccccgacctcngggacccagcagcccctcccacctctgccctcctccctgcagactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggggta

SEQ ID NO: 411885 - DNA, 880 bp, Homo sapiens
agcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgcccctcgtcagcaccatgcggtgctcgtgggagtcgtcagggatgaccgctgactagtgctaatcgcatgaaactttaaaactttacagtcagaggcttcatttcctcttcttaacaccaaaaaaaaaaaagaaagaaaaaaaaaaaaaaaaaaaaaaaaaaagaaaaaaaaaaaaagagggggggcgcgcgccgcaaaaaaaaacccccggggggggcccaaaaaaggaggggaaccccactttttgtggaaaggggggccccaaagggggggggaaaaaaaacggagcgggggggccggaa

SEQ ID NO: 411886 - DNA, 2027 bp, Homo sapiens
ggacgcgtgggcaggtggctccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggggta

SEQ ID NO: 411887 - DNA, 2054 bp, Homo sapiens
agcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggggta

SEQ ID NO: 411888 - DNA, 461 bp, Homo sapiens
tgcactccagcctgggcaacagagcgaaattccgtctcacgaaaaaaaaaaaaaaaagttccaggaagaataaacgactggattcttcagaaatgccaaaacacgggagggcataggtcaggaaattaaattagcttcatttactaaaatgtagagtaatgggtttagcagattaggttgtaaggaaggcagaggctgaatgtcattctaagaaatttgaattgtatcctgaaggtgaggtataaaataataacacacatttacctttcagaatgaatattttggaggcaatagtgaaggtgggttagaaaggaggaaagactggagagagataaggagttagattcggaacccctacaagagaaaattaaggtctgaatttggggatggggtcgcagagggcagaggatgaagaaataaatacagaagacattagaaaggactctggtttgtggagtgga

SEQ ID NO: 411889 - DNA, 538 bp, Homo sapiens
agcggccgccccaaacctgcccggggctccttctccccttcggccccgattcccctttcccactagggctcccctctgttcactggctctcctcaccctaagtctgcagccaccaggaccagggagggggtgggttgcgggggtcctccttcctgccccttggctcaccttcccccatccacgcaccaggagcggagagcccggaactaagaactgtagacccagagaggtgagactggccccaagcacctgggtcctcaagaagagtcaccgtttccgtgccaggaggatccaaggtggggaaactgaggctgagagagaaggacgttgaccaaggtcacagggcaggagcagcagagacagagtctcgctatgttgctcagactggtctccaacttctggctcaagcgatcctcctgccttgacctcgctaagtgctgggattaccgaatgggagccaccatgcccagtctttactcaaaattcaccttctccctgggtcttctctggagaccctagctttaaaaataaacaagta

SEQ ID NO: 411890 - DNA, 444 bp, Homo sapiens
agcggccgccccaaacctgcccggggctccttctccccttcggccccgattcccctttcccactagggctcccctctgttcactggctctcctcaccctaagtctgcagccaccaggaccagggagggggtgggttgcgggggtcctccttcctgccccttggctcaccttcccccatccacgcaccaggagcggagagcccggaactaagaactgtagacccagagaggtgagactggccccaagcacctgggtcctcaagaagagtcaccgtttccgtgccaggaggatccaaggtggggaaactgaggctgagagagaaggaccttgacctcgctaagtgctgggattaccgaatgggagccaccatgcccagtctttactcaaaattcaccttctccctgggtcttctctggagaccctagctttaaaaataaacaagta

SEQ ID NO: 411891 - DNA, 482 bp, Homo sapiens
cagattcctgcggagggggtccctgcttacatatccctgcacaggctcctgaggaagatgctacgagggtctggcctcccagctgtgagccgggaaaatccagttgccagtgactcctatgaggctgcggtgctctccctggccactgggctggctcactctggaactgactgctcccagctggcccaggggcttggcacctggacctgctcctccagtttgtacccctcaaaacaccccatcaccgtggagatcaatggaatcaacccaggcaacaatgattgctgggtgagtaccgggctctacctcctggaaggacaaaatgcagaagtctcactgtctgaagctgctgcctctgctggcctgagggtacagataggctgccacaccgatgaccttaccaaggccaggaagctatctcgagcccccgtggtgactcaccaatgctggatggacaggactgagcggtcagtctcctgcct

SEQ ID NO: 411892 - DNA, 428 bp, Homo sapiens
aggccccaagtggagatatactcacataggaaggaagaactgagccttctctgtgacttttgtcaggcaacaatgattgctgggtgagtaccgggctctacctcctggaaggacaaaatgcagaagtctcactgtctgaagctgctgcctctgctggcctgagggtaaggtctgaacacccacatctgccacctctcaaaaccgtagagctgtgtcattctcatccactgtctagttccagctcatggcaatgctgccaggagtacagagatggattattctgcccattttacagattttacagatgaagcagctaaatttcagggcatctaagtgagtgactgaagtgcctagtgttatcaagcaagagaagctcactgcagaatggactagaagccaaaactatgacacttgagtttttcaccaaa

SEQ ID NO: 411893 - DNA, 270 bp, Homo sapiens
ggcccttaggggaggcgcggcgcggcccgggcatggagcgtcccgggcccctggaggctcagtggagggttgggctccagggagctcagagctctctcgttcagggacccgagagtgacacgcgtggacgggtcgtgggcgggactccccagtgtgtcaccactgaggcatcttcgccctcttacgtgtctctgtttctctctctagaagtccaacacctccgagaggactcaaaacacagagtgaccagctcctatgtgcatttcctgg

SEQ ID NO: 411894 - DNA, 766 bp, Homo sapiens
tccgctgacctggggcagccagtcttgcaaccaaagccctctgctgaaacgctccgtgcagccctgtctactgagggctcaggatcttcaccttgctacttgaccagtcctgggactccatcctcagctcactacaggcaacacccttcaaagcaagatccttgcttcaatgggacctcagatttggacattcaggtttctggggctccactatgcacagctggggcttcccccaccagaccaagattctcccttccctgagaccctccaggccgaaatgacagtcacctcaacctgacagctcttcctgagcttcccaagtcacaggagaggttggatttgggaagcaatgctaagcagtggaatggacatcgacatagagagatcagctccacacttatactctgccactcaacttccccatgtgacttgaggatcactctaactccaaaacatagcaagctcgcggaacatcagggttcatgcaaagtattccaaggagccccttgaagcaacagaatggattgctcttctatggtggaatggcaccctggatgattaaaaccgtagcagcaaacaaaacctccatcaagtaagaattcagagtgtgagatatcacgcacagccacgcgtggatctttatatacgtgtcaatgtgtttgattgtatttttgctttcaaagtatgtattgagcatttcttctaggtcctcagtaacatctttttttaaaaaaaataaatgcttagggaattgttttatattaaa

SEQ ID NO: 411895 - DNA, 500 bp, Homo sapiens
acgtgttactgaaattttattcacttcctcccacaaacgttaggagaagcatacattaaatataaacatgttcccatttctactcagatacaatcccttctttcttatagtgaaactactgattcagtgtagcagtcaaagacaaatctaagtaaatacatttgactcaaaacctatgtatcaagaataaatactgtactttatgcatttatagatatttgattaattaatagcatgattttttttttcctaaaaggattgctcttctatggtggaatggcaccctggatgattaaaaccgtagcagcaaacaaaacctccatcaagtaagaattcagagtgtgagatatcacgcacagccacgcgtggatctttatatacgtgtcaatgtgtttgattgtatttttgctttcaaagtatgtattgagcatttcttctaggtcctcagtaacatctttttttaaaaaaaataaatgcttagggaattgttttatattaaa

SEQ ID NO: 411896 - DNA, 784 bp, Homo sapiens
tccgctgacctggggcagccagtcttgcaaccaaagccctctgctgaaacgctccgtgcagccctgtctactgagggctcaggatcttcaccttgctacttgaccagtcctgggactccatcctcagctcactacaggcaacacccttcaaagcaagatccttgcttcaatgggacctcagatttggacattcaggtttctggggctccactatgcacagctggggcttcccccaccagaccaagattctcccttccctgagaccctccaggccgaaatgacagtcacctcaacctgacagctcttcctgagcttcccaagtcacaggagaggttggatttgggaagcaatgctaagcagtggaatggacatcgacatagagagatcagctccacacttatactctgccactcaacttccccatgtgacttgaggatcactctaactccaaaacatagcaagctcgcggaacatcagggttcatgcaaagtattccaaggagccccttgaagcaacagaatggattgctcttctatggtggaatggcaccctggatgattaaaaccgtagcagcaaacaaaacctccatcaaatattcctgaaaacagagtcaagttatatttctaaagtactagcgtctgcttaaagaaatgacaaggtgaagtctttcacaaagtaagcattcaatgtatgatttctctgctatgtaaatctggttgttcatacagtttctatgacataattggccacgaccatttaacagggcttgaggcttaaaaaataa

SEQ ID NO: 411897 - DNA, 1042 bp, Homo sapiens
aatgatggtaactttatggtgataagtagattatgtgtagatttccagggagaacagtcatttggatgtataaatttttttaaaaaatcaagctcctcttaaaaggagctaatttttgcttgttagatataagggaatgacctacttcctcattttgtagtcaatgaaggagaatgtgaggtcccaaagaaatgaaggaaattatctaagtttacatgctgaggcaggcccgaacctggcaccagaacctcaccccgctgactaaccagaaaaggtgcttgtatgcctttcccccatacaaatgtttaccaggtgacagcattctggtaccaccttcataatttttgccatccgcaagtatcattattactgtcacttacattttatttatttatttatttattttgaaatggagtctccctctgtcgcccaggctggagtgcagtggcacaatcttggctcactgcaagctccgcctcctgggttcacaccattctcctgcctcagcctcctgagtagctgggaatacaggcgcccaccaccacaccaggctaattttttgtattttttagtagagatggggtttcaccgtgttaggcaggatggtctcgatctcctgacctcatgatccgcccgcctcggcctcccaaattgctgggattacaggcgtgagtcaccgtgcccagccttgtcacttacattttctttatgtcaacttatttcatgtaaaatacatttatttaaaacaatgttatttaaaaatgaaacttgctatcatattttagatggaaaacctgtagtataaactatcagaaaatacaattaagacaatactgttttagttagatgtttgttttgaagctgaagcctgttctatttttgttcaaaggggagattagtaatttttaggtattaaagatacactcaaccaaagggacagaatgggaaaggctgaaaggggaatgaataacgttctcatcgttcaagtcattgccggtgccacacccagagaaaaacaagcaccacaccagacagcctctca

SEQ ID NO: 411898 - DNA, 533 bp, Homo sapiens
aaaaaaaaagcaaaaaaaaaaacacccctcaattttggattacattgataattaggggccagatcataaagagagctttatttactgtattagtttgttcttacactgctatcaagatatacctgagactgggtaatttataaaggaaagaggtttagttgactcatagttctgcatggctggggaggcctcaggaaacttagaatcatggtagaaggcacctcttcacagggtggcaggggagagaatgagtgcccagcgaagggggaagccccttataaaaccatcagatttcgtgagaactaacacaatcacgagaacagcctggaggaagccatccccatgattcaatcacctcccaccaagtccctcctacaacacatggggattatgggaactataattccagataagatttgagtggggacaagcctaatcatatcaacgtatcatgaaaagattacattttattccaggggtcatagaaaccattgaagaattttactactaagagagatgtgatctgattggca

SEQ ID NO: 411899 - DNA, 264 bp, Homo sapiens
acaaaaataagccaggcatggtggcatgtgcctgtagtcttagctatttgggagggtggcgtgggaagattgtttgagcttggctcatcaatggttcagtgagctgtcatcacaccactgcactccagcctgagtggcagagccagacattgtgtcaatcatcatcatcatcatcatcatcatcatcatcatcatcttgaagaactcacaaatatgtggaaattaaatatccttcttaatgacacataggacaaaggataaatt

SEQ ID NO: 411900 - DNA, 209 bp, Homo sapiens
ctccagtgcctccagaggtcaagctgttaccctggggcccaaagtccccacagtaaatcccattgttaggctatccattgtgacccaaggacccccaggtaaacaaaggcgttcttaccgggcaggacatttcaaggacttagtggttaccttctgggagccaaggacaaagactaaacctctgtacaagatttaatcctctactgcac

SEQ ID NO: 411901 - DNA, 422 bp, Homo sapiens
agatagaagcaagaaagagtcaagagcgcatcaggccctctgacctttgcccttggccatctgcagcataggaggatgccccttgtgccaggtggctctcagaatctggggactgtaagagccaggatcagcacccgtcagtcacatgctgagcccagcactgacaatgaacgtgttctgtctatgactcaagatatacactccatcttcttgaaccttaaaaatattacattgagttcctcaggaaacagcatttagaaatgcaagcattttcatctcatcgtttatctttaagacaaggttctggagcctcctaggaactcatttaagggtgctgaaaaaggagtgggtgaggctttagtttgcttaatctcaatatttgaagtgtataacattatatttgaactaaagtttaatttgct

SEQ ID NO: 411902 - DNA, 364 bp, Homo sapiens
cggcacgaggtcaaatggcagctccagcctctgaatggtaaaactcctctatgtgggcagaacactacacatcatttgctactagccagtcttttgattgcatcctcacaagttaggggaccactgtggtttgtcagctatgcccaagggtagggtcacatagtacagaggacttttcgttccaagggctacaggcaggactgtttatattagcaggaaaaggttcctcaacaaggaagacaaacaatactgctggtgcaaagtgtcacatcaggttacagaaaatgaggggcagaaacactgagcctgtaaagagaatttcctagcccaagtgaacagtggtctaaggcaaagcaaaaaaaaa

SEQ ID NO: 411903 - DNA, 438 bp, Homo sapiens
tcaccaagcccgctgagctcctcctcgcacgagtaccagatgccggtgtggaaattcctgaagaggaagcggtcgtcgccggtctcccagctgtagagcgcgccgccaggggggccgttccccgaggcggtggcggcggcggcggcggcggcgggggcggcggtgccgttggccgtggcgttggcgcccgagttggggcagttggcgcgcccgccctggccgcagcccggcttggggacccgctgcgtgccctggcaccagtgcgtggtgaggaaagcggtggtggcgaacagcagcgccagcaggttcagggccacggccaggagcgctcggccgcggcggctagtcttcatgccgcccgcgccgccgggacgggactgcaccgccggggagctccgcgcgcgaagttggcagctggcgccccgcgtcagcggccgc

SEQ ID NO: 411904 - DNA, 582 bp, Homo sapiens
gctttgtagtttctattcatgaggtagtgttacttctttatccccctaaagacaaaatgaagataaagggggattgccaggaatgggtttaaaagcacaaatttggtagcttatcatctacaccatggagagtgaacccttacgaaatgacagtcaaatgagaccatcctagaaaaagaagatgctcataggcatttgtaccatgatcaaccccacgcatatgaaaactatgaccaagtgacgtgcctgggagctttgacacacaagccatgtgaattcactaggaaacacgtaataagacttggcaaggattccaagaaatcataatgcccagagtttgcaagtggcgagaaagtgagcattctcatacacagatgcagctatctcactgtctgtctcacactcactgagggtgatgtttcaggagccactggacagaatcttctgcggcaaacctgagaaagaaaactgaaattactgctttgaagtgacgggttactcagaaatactgaaatacatattctataaaatgtaaacttttgattttgactctaataaaatgttaagcctttgaaatatttg

SEQ ID NO: 411905 - DNA, 700 bp, Homo sapiens
gctttgtagtttctattcatgaggtagtgttacttctttatccccctaaagacaaaatgaagataaagggggattgccaggaatgggtttaaaagcacaaatttggtagcttatcatctacaccatggagagtgaacccttacgaaatgacagtcaaatgagaccatcctagaaaaagaagatgctcataggcatttgtaccatgatcaaccccacgcatatgaaaactatgaccaagtgacgtgcctgggagctttgacacacaagccatgtgaattcactaggaaacacgtaataagacttggcaaggattccaagaaatcataatgcccagagtttgcaagtggcgagaaagtgagcattctcatacacagatgcaggtcgtagcttagatatcaccttccttgggaagccttctctgtctcctctgtccactggacttcaggaaatccaggtcccatatctggatcaggccgctctggtgaatgcaactttcctcagccctggtgcccagcccagtgtagcagtggcagcagttcctggagccactggacagaatcttctgcggcaaacctgagaaagaaaactgaaattactgctttgaagtgacgggttactcagaaatactgaaatacatattctataaaatgtaaacttttgattttgactctaataaaatgttaagcctttgaaatatttg

SEQ ID NO: 411906 - DNA, 354 bp, Homo sapiens
gggaaggcggagtatttctgagccaagaccctgacagcctctctggttgagcacagtggccccgtgctgagggcgggttgtcccagagcgcaggtggggacagtatcctgtgggcgatagggagccatggcgggtgtttgagcaggagagggaccagggttgaggaggcacctatggggcaggtttgaggctctgagtcactgaggaaaaccagagcggcactacatccccgcccctcgatctcaattctcatctcctaatacatccagttgttttttttcctctcacctcagggttcttcaccgttttcattgttcttaaacgactgcacttattaaacaataataagcctgg

SEQ ID NO: 411907 - DNA, 2158 bp, Homo sapiens
ctgcgcgcggcctcgttggccgcacaggcgcagtggagctcgggcggagttgtgggagtggaggaggaagaggcggtagggggtacgggggctggtcccagaagatggcggaggcgggggatttgctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccatacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411908 - DNA, 2640 bp, Homo sapiens
ctgcgcgcggcctcgttggccgcacaggcgcagtggagctcgggcggagttgtgggagtggaggaggaagaggcggtagggggtacgggggctggtcccagaagatggcggaggcgggggatttgatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcaggctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411909 - DNA, 2893 bp, Homo sapiens
actcactatagggctcgagcggccgcccgggcaggtgggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcaggctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatcatctgggttaagagtctgtttttcttcctttgtggtaagtcttagaatatggtactgtggattaatctaatgaaattaacatatgtggttgaagttaccaagaaacgatgaaaagaaactaaatatagttgacccttgaacaacaggagttaggggcaccactccccaacatagttgaaaatccatgtataacttttgactcctccaaaacttaactactaatagcctactcttgatgggaagccttaccaataagaaacagttgatgaacacatattgtgtatggtatatgtattatatactgttttcttacaatagtgtaagctaaggaaaaaaaaat

SEQ ID NO: 411910 - DNA, 2253 bp, Homo sapiens
ggggtctcccggcgaagcgcgggtgacgtggtgctgaggaaagcggcctgaggaggagggtggcccttgggaagaagaactacttgtgtttttgcagcctgggaaccctggtggcaggtgctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411911 - DNA, 2093 bp, Homo sapiens
acagaggcatctcttatttagaaaaatgaacagatgatattatttggttacaacttttaagatgacttcttaacactgatctcagaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411912 - DNA, 2554 bp, Homo sapiens
actcactatagggctcgagcggccgcccgggcaggtgggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccatatatttcatctgtcactagccagagtgtgaacttgatgattcgaggagtagtgctattttttattggagtatttcttgcattagtgttaaatttacttcagattcagagaaatgtgacgctctttccacctgatgtgattgcaagcatcttttcttctgcatggtgggtacccccatgctgtggcacggcttcaggctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411913 - DNA, 2258 bp, Homo sapiens
ctgcgcgcggcctcgttggccgcacaggcgcagtggagctcgggcggagttgtgggagtggaggaggaagaggcggtagggggtacgggggctggtcccagaagatggcggaggcgggggatttgctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411914 - DNA, 2307 bp, Homo sapiens
gtagatttctgttgtgagttttcctgctttgacaatatgacctacagcctcattaaagggctagagtggaaaggagtgtcagtaaaaggtgctacatgctgaagactaaaacgggaagctggtaggggcgagactgatctacgtaagaggccagccagaaccttcagaacattgctgtgattgggttattatacccctgcattgacagacatctaggagaaccacataaatttaaaagagagtggtccagtgtaatgcggtgtgtagcagtctttgttggtataaatcatgccagtgctaaagtggatttcgataacaacatacagttgtctctcacactggctgcactatccattggactgtggtggacttttgatagatctagaagtggttttggccttggagtaggaattgccttcttggcaactgtggtcactcaactgctagtatataatggtgtttaccaatatacatctccagatttcctctatgttcgttcttggttaccatgtatattttttgctggaggcataacaatgggaaacattggtcgacaactggcaatgtacgaatgtaaagttatcgcagaaaaatctcatcaggaatgaagaaggcaaaaaatatcttttgtacagaaaagcaagatgaaaaggatgtgaaatggtagatataccaacaaaacttcagactgtaaaattgccaggatgcagttttccccttgattggcgtgtgtgtatatatggataaatatatatatacacacacacatattactgcaatctgtgattgcttcatctgtaaatcagttgtaaacctttacatatttgacttaaataactgtaagatatatatgtactacattaaaaagtgttgattaatagatgaaatttttaaattaattttttaaaacatgccatacattgtatcacaatgttaatgtgccaagatattgttcctgtcatgcagagtataagaatgctttgaacaatttgtagacttagtgaaataaaataagaggaaagccaaaaacaaacaaacaaaaagcatatggggagctggtattttctctttagcttactgttgtgcctttttatttttctaatcacagcagtatgagttatgagtgccctaatttgtggttagtttctaatttaatgttgtttcatagagtttggagtgttttgatacagggtgaaaatgaacttctggtttcaaacctgcgttactggagacagcccaaagagtaattttctgttttgacaggttttactggaagtatatgtgatgagcagaagaggttatcagcattaaattgttttggttctaaatttggaacagtatatataattaaaagtaaggaacattagaggatttaattagaataaatacatgttttggaaatacagtgacctcttgcagtgtcacaaaagtgcaaagtgatattagctgtcatctgcaatacagaatctcattgcttttgcacatggagcatataggaaactccaaacagatcacaatgaggtttctaaatctgttgggttctgtcttctattgggttctgtgaagcaaaccactgtagctttagctgggttcagtcatatgactcgttggtggaatgcctaggtttttcatcttacatgcagtcttgggggtggatgaatacataatttcttatgtattcgtgtatccattagtgaatagttcaagtctgtttaagagtgtattgagatggcattctctgcatgttaaagatcttaatggcaaccagcacctcttaagtatggtttaaacatattcttagctaattttttccattagtttttgaaattggtggcagttgtctgatccacaagggcaagatcttctgagtactctggggtgtgagtatgtgtgcacacgtgtgtgttggagtgagtgagagaatgtgtctgtgcatgtggccatgctttcctagaatgtcaagtagatatttttacactttgagttttaaagcaattactatcagactgagatcttgtatgccaaactttaatctgcttttatgttttcaggctgaaggtgtgaaaatcctaagaggatttcatattgaatatgtgtacacaatcttaactatcgtggtggaaaacatactactataatttattattatatcttccagataatgttattcatttagaacaaataaggtatattttttagaatcaactttgtaagcactataaaatctttaataagttataaggtctatgatgtgtttactttaaaaattgctgttaaaagcaacacgtattaaatatgtaattatca

SEQ ID NO: 411915 - DNA, 7125 bp, Homo sapiens
gctttgaaggactttctaggggcatcaagggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 411916 - DNA, 4958 bp, Homo sapiens
gctttgaaggactttctaggggcatcaagggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 411917 - DNA, 4225 bp, Homo sapiens
gctttgaaggactttctaggggcatcaagggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 411918 - DNA, 434 bp, Homo sapiens
acctaccccgagctggaggaaggagtggagctgctggaaagcccgccccaccgagtggacggccctgccgaccttggcgagagccccctcgcctttctcaccagcaacccaggtatggctgtgcagggtgctgggggcgagtctgaactccgttgtgccacgacccggggagtttatcatgcggcttgtgtgtttcagtgagtgcctctgtctggcaggtggtataaaatgtgtgtgcaagatgggctgatgactggccctgcatttcctgttgaaatttcaaaggcgcagggaactttattttctcatagagctgttttgctacagatccacctgtcacccatgggcagctttataatgcttctgctgtttctcattttggggaaaggtgaatatttagaagactttgctgtggatagagatacagaggcaca

SEQ ID NO: 411919 - DNA, 5522 bp, Homo sapiens
cgccccgcatcgtgcccggccccgtcgcggagatcccggacgaccgtcgcgggttgatggtcgcattccagatgtaaacagcttcagaagcctgacggtcatatggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataaaacccaaaagtgtctaatgtattcattcattagctaactaaaagcccaaaaaagacaagacacccag

SEQ ID NO: 411920 - DNA, 6174 bp, Homo sapiens
gctttgaaggactttctaggggcatcaagggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcagggcctgaacaattaaaagaaaaaagattctatagcactggaaagcaaatcaccccaggagttaacggatgtacaacagattaatttaagggatagtagcacacacacgatccttctatctgaaatcagtctcctagctggggaaacctctttcacacacaaaatgaaatgtgtacagcttgccgtgttctgactgtacccttccctcttccatgtctgagaatctccgtgtattttaagaatgtgtgaggagagggtggcgattcatgtttcaatgagcctctttttttttttccttcctgttttggtctatggctggtcttactctgtgtccatgttcggaagctctagttttgcatagaattatagagatgccaaactctttgaaaagagatccaaatttatcgcttgagagaaagaaaagaaacactattttttgtattttacctgagatacaggggcacaaatagatgagaattttacagtgttagtgtatgtatccctgagcctaaaaaatgaggatataaccttttacagagagagtgaggcgtggtggttttatatttatatatgaaaggccagcaagctcatgcgaaggatatacttttcttccaaaaagcggattttttttttttaatgtttgaatctatatttgagatgggagtttggttggattaaacatgacaccccggtgggcggtgtgtgtgtctgttgcacatggcagggaggggagcctccttctcatggggttgccatggtgatcattggtttttccatcaaaattgcatcttcatccatagattaccttccccttccctgacagtccataaccaaacctttaaacagaacaacctctttaaaaacttctcttgtgtttaacactttcttcatgccaacgaaacagggtaaacatgctcaaaacattaacagtctaaacagatatccaaatactaagaagaaaaacaagttatagcactttcaattttttttttttttttaaaaaaaggtttatagctttttcttttcccatgtcacaatgtccacttcctaagaagggtttaaaatactatgaaaactttctttttggggaaaatatctatttggtgtttgacacatcagtaggtactttaaagacctgaattttatagtagctttaggagttatattttataaaaatcagttatgactttatatttccagacaatagagagttcagtacatcatgctcttgtgcctctgcctgcttttcctgcgttcccaccctgtattccccccgcctttcgggtttccagggcttcgagcttgatcttttgaaagttttattctattaaatttttgctatatcttctggttttctgaaaaagctttagaatggtttctataccctttgtatcactgcatttttccatatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtcaaacaataaaaataacgaaaagtg

SEQ ID NO: 411921 - DNA, 5508 bp, Homo sapiens
gctttgaaggactttctaggggcatcaagggtagaatcactgtggactgagacccacctttctagacctgaagcccaggaggaggaagaggaggctggttggtaccatgggcataatgctctgaatcctagtctctcacctagtatgtgagcagtccctgcagatggcccatttggagatcttgacaaagcctcttctgtttccaatggggtttttggcgcattctcacagacttagatgaaactgtgatggccaccgcagggggcaggtgctgacatcgtccccagccctgtggctgttcatccggacatcatttccaacctcaatatctaaatgccacagtgctcttggagcaagttgggctggggaccactgttgccttttaagaccataaaaccatgggaaacgcagaaagtcaacatgtagagcacgagttttatggagaaaagcatgccagcctggggcgcaacgacacttcccgctccctgcgcctctcgcacaagacgcggaggaccaggcacgcttcctcggggaaggtgatccacaggaactccgaagtgagcacccgatccagcagcacccccagcatcccccagtccctggctgaaaatggcctggagcccttctcccaagatggtaccctagaagacttcgggagccccatctgggtggaccgagtggacatgggcttgagacctgtgtcttacactgactcttctgtcactcccagcgtagacagcagcatcgtcctcacagcagcctctgtgcagagcatgccagacactgaggagagcaggctttacggggatgacgctacatatttggctgagggaggcaggaggcagcattcctatacatccaatgggcccactttcatggagacggcgagctttaagaagaaacgctccaaatctgcagacatctggcgggaggacagcctggaattctcactctctgatctgagccaagaacatttaacaagcaacgaagaaatcttgggttccgccgaagagaaggactgcgaggaggctcgggggatggaaacgcgggcgagtccgcggcagctcagcacctgtcagagagccaattccttgggtgacttgtatgctcagaaaaactctggagtgacagcaaacatggggccggggagcaaatttgcaggctactgtcggaatttggtgtctgatattcccaatcttgcaaaccataagatgccaccagctgctgctgaagagactcctccgtacagtaattataacacacttccctgtaggaaatctcactgtctctctgaaggtgccaccaacccacaaattagccatagcaacagcatgcaaggcagaagagctaaaacaactcaggatgttaatgcaggcgagggcagtgagtttgcagacagtgggattgaaggggccactaccgacacggacctcctgtccaggcgatctaatgccaccaactccagctactcacccaccacaggccgggcctttgtgggcagcgacagcggcagcagctccaccggggatgcggctcgtcagggggtgtacgagaacttccggcgggagctggagatgagcaccaccaacagcgagagcctggaggaggccggctctgcgcacagcgatgagcagagcagcggcaccctgagctctccgggccagtcggacatcctgctgaccgccgcacagggcacggtgcgcaaggccggcgccctggccgtcaagaacttcctggtgcacaagaagaacaagaaggtggagtcagccacccggaggaagtggaagcactactgggtgtccctgaaaggatgcacgctatttttctacgagagcgacggcaggtctgggatagaccacaacagcatccccaaacacgccgtctgggtggagaacagcattgtgcaggctgtgcctgagcaccccaagaaggactttgtcttctgcctcagcaattccctgggtgatgccttcctttttcagaccactagccagacggagcttgaaaactggatcaccgccatccactctgcctgcgccactgcggtcgcgaggcaccaccacaaggaagacacgctccgactcctgaaatcagagatcaaaaaactggaacagaagattgacatggatgaaaagatgaagaaaatgggtgaaatgcagctgtcttcagtcactgactcaaagaaaaagaaaacaatattagatcagatctttgtctgggagcaaaatctcgagcagttccaaatggacctgtttcgtttccgctgttatttagccagccttcagggtggggagctgccaaaccccaaaaggcttctcgcttttgcaagtcgaccaacgaaagtggccatgggccgccttggaatcttttcggtatcatcgtttcatgccctggtggcagcacgcactggtgaaactggagtgagaagacgtactcaggccatgtccagatccgcgagcaagcgaaggagcaggttttcttctctgtggggtctggatactacctccaaaaagaagcagggacggccaagcatcaatcaggtgtttggagagggaaccgaagctgtaaagaaatctttagagggaatatttgatgacattgttccagatggcaagagggagaaagaagtggtcttacctaacgttcaccagcacaaccctgactgcgacatttgggtccacgagtatttcactccatcctggttctgtctgcccaataatcagcctgccctgacggtcgtccggccaggcgacactgcacgggacaccctggagctgatttgcaagacacatcaactggatcattctgctcattacctgcgcctgaaatttctaatagaaaacaaaatgcagctctatgttccacagcccgaggaagacatctatgagctgctgtacaaagaaattgaaatctgtccaaaagtcactcacagcatccacattgagaagtcagatacagctgctgatacttacgggttttcactttcttctgtggaagaagatggtattcgaaggctgtacgtgaatagtgtgaaggaaaccggtttagcttccaagaaaggcctgaaagcaggagatgagattcttgagatcaataatcgtgctgctgacgccctgaactcttctatgctcaaagatttcctctcacaaccctcgctgggcctcctggtgaggacctaccccgagctggaggaaggagtggagctgctggaaagcccgccccaccgagtggacggccctgccgaccttggcgagagccccctcgcctttctcaccagcaacccagggcacagcctttgcagcgagcagggcagcagtgctgagaccgctccagaggagaccgaggggccagacttggaatcctcagatgagactgatcacagcagcaagagtacagaacaggtggccgcattttgccgcagtttgcatgagatgaacccctctgaccagaacccatctcctcaggactccacggggcctcagctggcgaccatgagacaactctcggatgcagataagcgtgcgcaaggtgatctgcgagctcctggagacggagcgcacctacgtgaaggatttaaactgtcttatggagagatacctaaagcctcttcaaaaagaaacttttctcacccaggatgagcttgacgtgctttttggaaatttaacggaaatggtagagtttcaagtagaattccttaaaactctagaagatggagtgagactggtacctgatttggaaaagcttgagaaggttgatcaatttaagaaagtgctgttctctctggggggatcattcctgtattatgctgaccgcttcaagctctacagtgccttctgcgccagccacacaaaagttcccaaggtcctggtgaaagccaagacagacacggctttcaaggcattcttggatgcccagaacccgaagcagcagcactcatccacgctggagtcgtacctcatcaagcccatccagaggatcctcaagtacccacttctgctcagggagctgttcgccctgaccgatgcggagagcgaggagcactaccacctggacgtggccatcaagaccatgaacaaggttgccagtcacatcaatgagatgcagaaaatccatgaagagtttggggctgtgtttgaccagctgattgctgaacagactggtgagaaaaaagaggttgcagatctgagcatgggagacctgcttttgcacactaccgtgatctggctgaacccgccggcctcgctgggcaagtggaaaaaggaaccagagttggcagcattcgtcttcaaaactgctgtggtccttgtgtataaagatggttccaaacagaagaagaaacttgtaggatctcacaggctttccatttatgaggactgggaccccttcagatttcgacacatgatccccacggaagcgctgcaggttcgagctttggcgagtgcagatgcagaggcaaatgccgtgtgtgaaattgtccatgtaaaatccgagtctgaagggaggccggagagggtctttcacttgtgctgcagctccccagagagccgaaaggatttcctaaaggctgtgcattcaatcctgcgtgataagcacagaagacagctcctcaaaaccgagagccttccctcatcccagcaatatgtcccttttggaggcaaaagattgtgtgcactgaagggggccaggccggccatgagcagggcagtgtctgccccaagcaagtctcttgggaggaggaggcggcggctggctcgaaacaggtttaccattgattctgatgccgtctccgcaagcagcccggagaaagagtcccagcagccccccggtggtggggacactgaccgatgggtagaggagcagtttgatcttgctcagtatgaggagcaagatgacatcaaggagacagacatcctcagtgacgatgatgagttctgtgagtccgtgaagggtgcctcagtggacagagacctgcaggagcggcttcaggccacctccatcagtcagcgggaaagaggccggaaaaccctggatagtcacgcgtcccgcatggcacagctcaagaagcaagctgccctgtcggggatcaatggaggcctggagagcgcaagcgaggaagtcatttgggttaggcgtgaagactttgccccctccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataagcttgagtcctatcttctgtatattactaagggcttttatttattctcaataaatcatagcccgaccaactgtaacaagcaagcttctctacccgcagacagagctcgggtccgagctgaattcctat

SEQ ID NO: 411922 - DNA, 586 bp, Homo sapiens
aggaaagaagttagtttcagaaatactatgttcttaccccagaagacagatctaagtctagttttatttgaaataacttttgttaacaaggaggtgatataatggtaatgtcaggtatttatggaattcacgatatgggtaatcagatgataagcaagggatgtagaaagggaattgtcagaaactaaagacaaatttaattggctttacactttggcctagaatcataccacactgggtgatgacacttagaaatgcccatcaccatcatcatcatcatcatcatcatcatcatcattgctgttattattaagtgcctagatacttgctaataagtggaagatgaagatgctctctctatattatttcatttaatcctctcaagaaccattggatagataactctttttgacagacagataaaccaaggcgttggcttaggccaaagcatttactcaatgtgatatggaatagaatggccagaagtagttgacaggccctaaggagagcttcacagctaacatcaggaaaggattcattgccattagcctatgtcctggctcttggtggtaagtattccatctgc

SEQ ID NO: 411923 - DNA, 540 bp, Homo sapiens
tttgaaatcatagcttgggagttgtttatgcttcagagatttttaaaccaaggctaccttttaatgtaaatgcacttaaattgaccccacttatttaaatgatgtgaaatagctcagcaatgttcccatgacctgtttttataccttttgatattttatgtgacctccaataagctggacagataataacagaacccttggcattgggctaccactgccactgtgatgctgagtctggtgtcagcagtgaagatgagggtgggaagccaccgaggaagctggaggttgacacaagtggcagtaagggcacatcattacctaggaagaaccttcagaaatcctctgcaaaagacggcctgtttccacccttcctattcttgtttcttccttctgccactttttttttttttctttcaactaaggaatagaatggccagaagtagttgacaggccctaaggagagcttcacagctaacatcaggaaaggattcattgccattagcctatgtcctggctcttggtggtaagtattccatctgc

SEQ ID NO: 411924 - DNA, 882 bp, Homo sapiens
ttggatcataaacagagggcttcgattccaggatgggggttcctccagggggaaatgaaaaggagctctcactctgttcttacgtatgcacaatgctctgaattgtggcacatgggtttgcagaaggataatggagataattgaaagtaatgaaaatgaaaccaaatctccttccccaaaaacttaaaagaactgattcaaaagtaccccaagaatatgcaaagaaaagggaatcacatcaacagatgattggataaagaacatgtggtatgtatacataatggaatactattcagccactaaaaagaatgaaaccatgtcttttgcagcaacctggatggaactggaggctgttatcttaagtgaaataacttagaagtagaaagtcgaatacttcatgttctcactcataaatgggagctacataaagtgtacccatgaacatagagtgtggaacaaacattggagactcagaagggtgggaggagggtaagggatgagaaagtacctgatgggtacagtgtacacttttctggtgttggttgcaggaaaagcctggacttcaccacttcgcaatatatccgtgtaacaaaactgcacttgtacgccttatatttatacaaatttaattttttaaaagggaagagagaatcatattaatttctcaccactttttaagtaagcaaacagcagtatttcccagaggcaagaggttcagcaagaagtcaggaaatgtttttgtagataagcatctatcattctgatgggccatgactagtgtgttcacttgtaattcctttgcctttaaaaaaagagaatgatatcaaaaaataagtgccttatactgtgaaaaacgataaaaggacttcctgattctaagtg

SEQ ID NO: 411925 - DNA, 433 bp, Homo sapiens
tgtctcaaaaaaaaaaaaaaaaaaccacacacacacacattgagacttgagatgtggtgacacttggatcataaacagagggcttcgattccaggatgggggttcctccagggggaaatgaaaaggagctctcactctgttcttacgtatgcacaatgctctgaattgtggcacatgggtttgcagaaggataatggagataattgaaagtaatgaaaatgaaaccaaatctccttccccaaaaacttaaaagaactgattcaaaagtaccccaagaatatgcaaagaaaagggaatcacatcaacagatgattggataaagaacatgtggtatgtatacataatggaatactattcagccactaaaaagaatgaaaccatgtcttttgcagcaacctggatggaactggaggctgttatcttaagtgaaata

SEQ ID NO: 411926 - DNA, 526 bp, Homo sapiens
actctcatttcatccacagtgacccaggcacccaattattgaatgcttttagaagtcttctcaaatgaatctctatgaacagcagtaataacggtctcaggtctgaagtccactgcggtcagccttccctggtggtgagctgctgtcagaacctccccactactcctctgggtggccccagtcttgtgcctatttccctctcgtggtcatcaagtctcgcccagtggaaattgacttccttgttctgagctgccccatggagaggccatgtggcaaagaattgagggtggcctccagccaacagccagcaaggaactgtggccttcggtgggaggaacagaatccaactaacaaccatatgagtgagcttggaagcagatgcttccccggttgagacctgagatgactgtagacccagttgacaccttgattgcagcctatgaaaggccctaaagcaggggacccagctaagccaaggccaggttcctgacccataggaactgtgagataataaaatttttttttt

SEQ ID NO: 411927 - DNA, 273 bp, Homo sapiens
taggtggcccccgttggctctcaatggggcagctcagaacaaggtaagtcatttccattttaacgttatgaaaaagctatcagggacaggagccaagatggccatatgagtgagcttggaagcagatgcttccccggttgagacctgagatgactgtagacccagttgacaccttgattgcagcctatgaaaggccctaaagcaggggacccagctaagccaaggccaggttcctgacccataggaactgtgagataataaaatttttttttt

SEQ ID NO: 411928 - DNA, 654 bp, Homo sapiens
taaaaaaaaaaaaaaaaaaaaaaataaaaaaaaaaaaaaaaaaaaaaaaaaaaaaaaaaaaaaaattttattatctcacagttcctatgggtcaggaacctggccttggcttagctgggtcccctgctttagggcctttcataggctgcaatcaaggtgtcaactgggtctacagtcatctcaggtctcaaccggggaagcatctgcttccaagctcctcttaagtgtaagctggatctaaaaacttgctatcaacgaacataatacagcaaaaagatgagatgtcacttctgagattagattatggaagactatgacttgtcttgctcactctcttgctttctccctccagtggaaattgacttccttgttctgagctgccccatggagaggccatgtggcaaagaattgagggtggcctccagccaacagccagcaaggaactgtggccttcggtgggaggaacagaatccaactaacaaccatatgagtgagcttggaagcagatgcttccccggttgagacctgagatgactgtagacccagttgacaccttgattgcagcctatgaaaggccctaaagcaggggacccagctaagccaaggccaggttcctgacccataggaactgtgagataataaaatttttttttt

SEQ ID NO: 411929 - DNA, 500 bp, Homo sapiens
gcctccgaccatggggaccacaggcccctctgaggacctgccaggacggccaggctgggcagcggcactccacgacacaggctggggtggggacccggaggcggcagggccgaccctcagctctggtgaggctcagaccaggacccggcggacaaggaatgtgatgcaagggatggtgtgggcgtgaggaaggctggcacttctcactgtgcctctgggaacctgggccacgacactcagaggccagctccctgcaaaaagaccgggcggccccagctgttcctgccatcctggctgagggttggacaggcaagtgtaggacgagcttgaatttcctgccactgccgaccacagccatggaactaaccccaggtatgacctacagaagaaccacccaactgaacccaacccaaataacagaatcgcaagcaaatacacagttgtttgaagcttctgtctgggggtggtttgttatacaatagctgactgaaacagatctc

SEQ ID NO: 411930 - DNA, 607 bp, Homo sapiens
gcctccgaccatggggaccacaggcccctctgaggacctgccaggacggccaggctgggcagcggcactccacgacacaggctggggtggggacccggaggcggcagggccgaccctcagctctggtgaggctcagaccaggacccggcggacaagggtaggccgtgcaagaatcttctcctgctaaactgcagaaaggccttctgtggctgtccacagatggctgcgacgcttggcagtagtgtgacttgctctgaccaacagaatgtgatgcaagggatggtgtgggcgtgaggaaggctggcacttctcactgtgcctctgggaacctgggccacgacactcagaggccagctccctgcaaaaagaccgggcggccccagctgttcctgccatcctggctgagggttggacaggcaagtgtaggacgagcttgaatttcctgccactgccgaccacagccatggaactaaccccaggtatgacctacagaagaaccacccaactgaacccaacccaaataacagaatcgcaagcaaatacacagttgtttgaagcttctgtctgggggtggtttgttatacaatagctgactgaaacagatctc

SEQ ID NO: 411931 - DNA, 367 bp, Homo sapiens
cgcccccaacaggcttccggtcctgagcaaccatgacctggctttgtctctgcagtgtgccctatttggacttgacttgaacgtgaatgcagccatacaacacgtagacggttgtgtctgaattcgtccacttagcgcgatgttttaaaggctcatccatgctggagcccgtgtcagtgcttcgtttctttttatggcttaaaaatcgtctatggtgggccacgcacggtggctcacgcctcggcctcccaaagtgctgggactacaggcgtgagccaccgcgcccggccgaaaaatcgaacttttaaaacacaaaaaagaaaaaaagaaaagaaaatgaatcactatctgacaccatgctcaagaa

SEQ ID NO: 411932 - DNA, 1616 bp, Homo sapiens
  misc_feature (855)..(855): n is a, c, g, or t
aacaaccaccggaaggcagaaagatctaagcagcagtctcagcagttgcccagcaccacaaacacagaggtcgaagttcaaatttggaggggcttggtaaacactgttaactttatggtgagatccaagaagggcatgtgtagaaattaagaccatttctaagaccttagggctgtttctagagccaactacaaaatggaaattgaccacatctaataaagtggctattttattgattatttttgaaaatagtcaataaaaagcagacccactagtgacctagatgttggaattggcagacaaattcttcaaaataagtatcagtgttttaaaaatgtatacagagaaatgtggatataataagtataataatgggaagtttcagaagaggtctgaaaacggggaaaaaaatcctaaaaccaaaaaagtatctaaaatcaaaaactcattgggatttacagcaaattggacacacacaagaaaggatcagtgaacttgagcacaggtcaataaaaaatgtccaaactgaaccacagagaaaaaagataaagggattaaaaaaaaaaaaacagccttgatgatcaaatacatgcattgacctggaaggagagaagatagagagtggaggctctgaaggagactcttattttctccattctgtggttgctggtaattcttggcttgtcagatgcctcactccaatctctgccattgtcttcacttggcattactctctgcatgtttttgtgtctttcttctctgcctcctcttataaggacactagttacattgaatttatagcccactttaatccattatgaccttatcttaactggatctgcatagactccgcantgagtcgaattgtgtccacaggtaagaaagacatgtttagtcctacccactaatacgtcagaatgtgacattatttggaagtcgggtctttacagaggtaagcaaattaaaatgagatcattacggtgaaccctagcccagtatgactgatggccttattaaaaggggaaatgacacagacacatagagaaggaagatgatgtgcagatacagagaaacaccatccacaaaccaaagggtgtctgaatctaccacaacctaggagaggcatgaagcagataacccctcacaatcctcagaaagaaccaaccctgccaacaccttgattttaggcatctaacctccaaaacagtcaaaaattattgtggtttaaaccactcaatttatagtactttgttacaacagccccaggaaattaatataaatcatatttctaaattgagtctcatgctgatattctgaatagatgaaattcggatacactattcaacctaatacatctactaaacgtttaaagaagaattaacaacaatcattcacaaactcttacaaaaagaagagggaacatttctcaatttattctatgaagccagcattagcctgataccaaagccagacagacataacaagggaaaacaaaacaagctgaagaccaatatttctgatgaatatacaggtataccctcatcttattgtactttgcagatactgtgtttttttaataaattgaaggtttgtggcaacccagcatcaagcaagtc

SEQ ID NO: 411933 - DNA, 423 bp, Homo sapiens
accttgaagactttcttacatctctctgggcttttgattaaaaggaggggtgagagagtgtaggtgggaaatttccaagccaaaaaaaaaaatcgttattaaaatattggcatgtaaatgctgaaaacattgattcacaaaacaattatactaggagaatctgaaagattgagacattcatcattgttttaagcaaagtaattaacttccagtgcacaaacttccttctcccgaaatccatcgagggagcagatgcccaaacattcatggtattggattaagaaaatggtacttgcttttcttccaagtaccagatggttccaagaatccaaagtcaatgaagagaagagcctgtgtttatttggtttatacaattcttattgagggtttatgagaaaaatcgtattttaatacctaccagat

SEQ ID NO: 411934 - DNA, 884 bp, Homo sapiens
  misc_feature (676)..(676): n is a, c, g, or t
tgctagccagtcgggacaaatacagaatgtgaggtcctgttccagtcaatggaaactggatacagcagtagggtggatgcggcaggttataaatgatgctgtctcctttgtttggtgtacactcgtggcaaaactgctggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgacagaatcttgctccgctgccaaggctggagtgcactggttcaatctcggctcactgcaaactctgcctcccaagttcaagtgattctcctgtgtcagtttctttaggaatacagcactccatattgctaccataataatgaaacggattcccatggctacagcgatgaagcagcagaaaaaaaatggagatgctgtcaaagaaaaaagacacagatcagagaaagaagcataaagggtttgggtatctttgtatttaatataaatattagagttttttaagaaaaaaaaaaaaaaaaaaaaaaattttgggggtgccctaaaaagttttaaacactttggttggggaggcggcccatagtaataacatggtcatgcngttccaggaaaactggtctgcatgtgtcgggttctcccaaaaaagccggcgaccggcttgtgacacccaatggtttcgggtctacggtctcaccggtcagcttctcccgccccccgccatcagagaagagacaacagaggtcggcaggagcggcgagggaaagaaagaagaagagcacaggagagacaaacgagcagcagaagaaaga

SEQ ID NO: 411935 - DNA, 539 bp, Homo sapiens
tgctagccagtcgggacaaatacagaatgtgaggtcctgttccagtcaatggaaactggatacagcagtagggtggatgcggcaggttataaatgatgctgtctcctttgtttggtgtacactcgtggcaaaactgctggtgagtataccctttctgcaggaagtaaaaaaaaaaatggccacactaaataaatctatgttcaagtgctatttttttatggcactggggaacaagcatttcaaacaatttggtggcagtctgtatggggatacattctcctccaggggtggtctccagtcctctctcatgagggagtgcactcccctacctcattgaaggggccctcaggaatgacaaattgaggcaaataaacccagactctcagcaacacagagagagaaaaaaaaaaagaaactggccagcaacctagcttaaaggatcctcacatactgtggcgacaactttgtgcacaggccaagaaagaagaagctgtgggagccaataaagtatttccttggtgatcgggactaaaaaaaaa

SEQ ID NO: 411936 - DNA, 805 bp, Homo sapiens
  misc_feature (597)..(597): n is a, c, g, or t
ctgggggctcatcaggattggagatgacagatttactgtcccctttgcctgcgatactaggtccccggggccaggagagacccggcatccaaggtgtgccacagctgagcttcacccggatatatagaccagctctccccacgtcccagcaccctgcctggcagcgcaatggaaccgaggatggggctgcaggacgataccagcacttcaggaactgtgacagaatcttgctccgctgccaaggctggagtgcactggttcaatctcggctcactgcaaactctgcctcccaagttcaagtgattctcctgtgtcagtttctttaggaatacagcactccatattgctaccataataatgaaacggattcccatggctacagcgatgaagcagcagaaaaaaaatggagatgctgtcaaagaaaaaagacacagatcagagaaagaagcataaagggtttgggtatctttgtatttaatataaatattagagttttttaagaaaaaaaaaaaaaaaaaaaaaaattttgggggtgccctaaaaagttttaaacactttggttggggaggcggcccatagtaataacatggtcatgcngttccaggaaaactggtctgcatgtgtcgggttctcccaaaaaagccggcgaccggcttgtgacacccaatggtttcgggtctacggtctcaccggtcagcttctcccgccccccgccatcagagaagagacaacagaggtcggcaggagcggcgagggaaagaaagaagaagagcacaggagagacaaacgagcagcagaagaaaga

SEQ ID NO: 411937 - DNA, 320 bp, Homo sapiens
ctatgtgaatgggtgggtttttacttagactaccttttcatgtagaatatgtagactaccttttcatgtagaacctagcttctatgcaaggttctcaatttcattttcctgtccacttgggcccagtgcttacctcatgtttccacatgagcgtgaaatcacaagcccttgggtgaacagaatcagtaatcactggtcgggtgcagtggctcatgcctgtaatcccagcactttgggaggctgaggtaggcggatcatgaggtcaggagtttgagaccagcttggccaacatggtgaaatcctgtctctactaaaaatac

SEQ ID NO: 411938 - DNA, 259 bp, Homo sapiens
ctggccaagggcacgacggcatcatcatagcaacagtgctgcagggggtcgtagaacttgtccccacatctcttgtgtggctggcacagcatcaggtccacttgggagcctacatgtcccaggcttcgtgtcagacaccagtgatgcagtgctgagtagaaaacgcaaagtcagtgtcttcgtgacgttcatgacagtgagaggagagagagagagagagaaggtaggagaataaaactcctgattttggttattgtcg

SEQ ID NO: 411939 - DNA, 728 bp, Homo sapiens
gtgtgggccctggacaagggctccttgggtctaagtataaggacaactactggccaaagaatacctgtgcccacgtggaaccacttaaaaactaaactgaattttacagtaaacacaggaggagccatgctgtaagcatatttattcaaaaacagggtgtcccaaaagtcttcctgcagttttagtaacctcaaggctataaatgctgcaacttataagaacaccatttgaaagttaatttaacactatttatctctgtgaatgttgaataacacgttttaactttaatttttgtttcagttcccctgagtgaaatatggcatacattaaccagaagagaaaattacatttattaaaataattaaaacagagtcaaaagaagtaaacgttcaaatgagttttgtaagtttgtagcatttcgacttaagaagttattaaagcttaaaactgcactgacctttttggggtaccctgtattcggatttgtcgtgtgtcaggttctgtgctagacacttgattaaaaagaaaaaacaagaaaaaagatagtcttctttagggaacttgaagtttagttgtggggaagggatgaaggggacacacagattgatcccatcatacaatataagagctgtaattggggctgataaagtgtgtgtgtgggggaacagaggacagggaccaaatgactctgcccgaagagccaggggaatcctgtcagaggaggtgac

SEQ ID NO: 411940 - DNA, 697 bp, Homo sapiens
ccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcgttcccctgagtgaaatatggcatacattaaccagaagagaaaattacatttattaaaataattaaaacagagtcaaaagaagtaaacgttcaaatgagttttgtaagtttgtagcatttcgacttaagaagttattaaagcttaaaactgcactgacctttttggggtaccctgtattcggatttgtcgtgtgtcaggttctgtgctagacacttgattaaaaagaaaaaacaagaaaaaagatagtcttctttagggaacttgaagtttagttgtggggaagggatgaaggggacacacagattgatcccatcatacaatataagagctgtaattggggctgataaagtgtgtgtgtgggggaacagaggacagggaccaaatgactctgcccgaagagccaggggaatcctgtcagaggaggtgac

SEQ ID NO: 411941 - DNA, 387 bp, Homo sapiens
ccagacccacagggcaaaaagtgcgtcgtcgtgtcccaacctcctggtcccagaaacctggccgcatcaagtcagcgcttcccatgctggaagaagcaagcagccccagggtggaatcttaaaaattaatgaagagcatcggcggggtgccattcaggacttacttgcaagcccaggatttacatttggaaagcgagtggtgtttgattcccactgtttaaaaaggcaacacacgttcgctgatggtctacattccagctgcactagcggtaagctcgcaccaagtgccactgtcctgccaagcactctcctgaatcactgcgctggagtctcagagccacctgatgtgttctgtaccattatacccattttgcaattgggggacac

SEQ ID NO: 411942 - DNA, 847 bp, Homo sapiens
ttatattatgacataaatataataataactcatattaataacaaagaagctcagtaggtcctgtccttcggtgttactagcggccaatgatggagagatctatgatgatatgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtctttaaaaaggcagtgctgtcttacctcttgctagtgggttaaatgttttcaaaaattatagcagtagtagaagttttgtataaaatttgtccttatttgttaattgtatataaatgtcaattatttgataccaatgttttgcatttagtatgcacattgaagtctaaactgtagaagagtctaaaacaagttctctttttgcagattcacatactaa

SEQ ID NO: 411943 - DNA, 650 bp, Homo sapiens
ggtgaacaccatggaaaacttgaaattgaaaacatcacaattttaatgagaaaaagcgcaacccaaagtgaagagcaccattataacaaaggtgagaaaagatgctcatcttatgacagagtcttgtttctgtgcagttatcagaaaaagtgagctaagaggtgtgatgtgcttatattgtttaatcctgattactaaataccaaatgcgttttcttcaaagctctaaaggagaagaaatggaatgggaacaagggggagggttgagggcagggaggatatcccacattgtcatattccttagagtaaggtttctatagctttcactttcctcaaatcgaactctggatctctcattgactagaagctgccacatgcctttttttattttttattttttatttttttgagacaaggtcttgctctgtcacccaggctagagtacagtggtgcattcatggctcactgcagccttgacctcccgggctcaagcaatcatcccaccccagcctccagagtagctaggactacaggcactcaccactgtgcctggctaatattgcatattcttttgtagaaatgaggtcttgctttgttgcccaggctagcctcaatcacctggcctcaagcaatcctcctgcctcagcttct

SEQ ID NO: 411944 - DNA, 2730 bp, Homo sapiens
cttttgtctctcagctattttttgttccctatgtttgtaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttca

SEQ ID NO: 411945 - DNA, 3314 bp, Homo sapiens
ggtgaacaccatggaaaacttgaaattgaaaacatcacaattttaatgagaaaaagcgcaacccaaagtgaagagcaccattataacaaaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtctttaaaaaggcagtgctgtcttacctcttgctagtgggttaaatgttttcaaaaattatagcagtagtagaagttttgtataaaatttgtccttatttgttaattgtatataaatgtcaattatttgataccaatgttttgcatttagtatgcacattgaagtctaaactgtagaagagtctaaaacaagttctctttttgcagattcacatactaa

SEQ ID NO: 411946 - DNA, 2149 bp, Homo sapiens
cagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggttagaagagggaactccatataggctctggttttcctaacggtttgcatgactgcattcatgtgcaagctaagtatcctctagtcaatccgctccatcttctgctgttgtctcaacaggtg

SEQ ID NO: 411947 - DNA, 1397 bp, Homo sapiens
  misc_feature (1356)..(1356): n is a, c, g, or t
  misc_feature (1392)..(1392): n is a, c, g, or t
cagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacacccactacctaaaaaatcccaaacatatagctgaactcctcncacccaattggaccaatctatcgccctatcaaaagncgagt

SEQ ID NO: 411948 - DNA, 409 bp, Homo sapiens
ctaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatgtgagtgcaaatttctctatggcttcgaagtattttctttgcgaggcaatattcaatgtacatattcctccagaactcgtcataggcatcgagttaggagtactttacagagtggacaaagggaggaaaatgttaaatggcaggtatagttccgtcttcacctcatctgttatctatattgtgggaaacaacgtacagttttatattattccaggaggaacgaacagcattaggtttttcattgatgtt

SEQ ID NO: 411949 - DNA, 421 bp, Homo sapiens
ctatttaagtttactttttctcatgtttttgcaccctcattcctttcaactcaagtccacagtgcctcttagccctcattttgttattgtaatttcacccctaagaattctttataaaataatcaacaaagtgtttttatttaaatggtttacatgaaagtgaaatgctctctgcagttaaataaggaagatttacaattaaaatctgagtgagcattacatggccaaattataaaattaacagaagattttcctccaatccaaatgaagggatattccctccaccaccagatgatgacatttatgatgggattgaagaggaagatgctgatgatgggtaagaataatcagtgaactgctttttgcaaattattatatatacattgaaatttagttttgatttccagttaaaataaaaagc

SEQ ID NO: 411950 - DNA, 3125 bp, Homo sapiens
cttttgtctctcagctattttttgttccctatgtttgtaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtctttaaaaaggcagtgctgtcttacctcttgctagtgggttaaatgttttcaaaaattatagcagtagtagaagttttgtataaaatttgtccttatttgttaattgtatataaatgtcaattatttgataccaatgttttgcatttagtatgcacattgaagtctaaactgtagaagagtctaaaacaagttctctttttgcagattcacatactaa

SEQ ID NO: 411951 - DNA, 3343 bp, Homo sapiens
cagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtctttaaaaaggcagtgctgtcttacctcttgctagtgggttaaatgttttcaaaaattatagcagtagtagaagttttgtataaaatttgtccttatttgttaattgtatataaatgtcaattatttgataccaatgttttgcatttagtatgcacattgaagtctaaactgtagaagagtctaaaacaagttctctttttgcagattcacatactaa

SEQ ID NO: 411952 - DNA, 3369 bp, Homo sapiens
cagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggctccacactacaggttcaagagaagagtaatacgtggtcctgggggattttgaagatgttaaagggaaaagatgacagaaagaaaagtatacgagagaaacctaaagtctctgactcagacaataatgaaggttcatcgtaagagtcaaccaaccaaatccagttttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcattctgctgtgttcattaggtgccaatgtgaagtctggattttaattggcatgttattgggtatcaagaaaattaatgcacaaaaccacttattatcatttgttatgaaatcccaattatctttacaaagtgtttaaagtttgaacatagaaaataatctctctgcttaattgttatctcagaagactacattagtgagatgtaagaattattaaatattccatttccgctttggctacaattatgaagaagttgaaggtacttcttttagaccaccagtaaataatcctccttcaaaaaataaaaataaaagaaaaaggaaaatcattcaggaagaaatgacctgtctaaaaaaacctaaggaagaataataatataagaaaggaaatttaaaaacattccacaagaagaaaaattattgtttatacttctacttatggttatatcttatattctctattcaagtgacctgtctttaaaaaggcagtgctgtcttacctcttgctagtgggttaaatgttttcaaaaattatagcagtagtagaagttttgtataaaatttgtccttatttgttaattgtatataaatgtcaattatttgataccaatgttttgcatttagtatgcacattgaagtctaaactgtagaagagtctaaaacaagttctctttttgcagattcacatactaa

SEQ ID NO: 411953 - DNA, 1538 bp, Homo sapiens
cagttcttgagttccacatgcagagcagatgcgacagctagaagtgagtagggcccagaccctggcccaggaagatccactaaaggaggccatccttccgccttcttctgcaggagtcaggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttacctatcaaaagacgagggtaccgagctcg

SEQ ID NO: 411954 - DNA, 772 bp, Homo sapiens
ggtcagtgtctcagccacagcggcttcaccatgcacagctgggagcgcctggcagttctggtcctcctaggagcggccgcctgcgcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaaggtgactccgggggcccgctggtgtgcgggggcgtgctcgagggcgtggtcacctcgggctcgcgcgtttgcggcaaccgaagaagccgggatctacacccgcgtggcagctatgcggcctggatcga

SEQ ID NO: 411955 - DNA, 1929 bp, Homo sapiens
cgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgctgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaattctttttgtggagattccttttttaaataaagaaataaataaaaggacaaaaac

SEQ ID NO: 411956 - DNA, 709 bp, Homo sapiens
cgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggctggcctcgaactcctgacttcaagtgatccacccgccttggcctcccaaagtgctgggattacagatgtgaaccaccgtgctgggccatggttttttttttttcaagggtagtgaatattatcaattcattgttgttagtgttattaataaaatattatttcagtcta

SEQ ID NO: 411957 - DNA, 1725 bp, Homo sapiens
cgcggacccgcagcgactccacagggactgcgctcccgtgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgctgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaaggaattctttttgtggagattccttttttaaataaagaaataaataaaaggacaaaaac

SEQ ID NO: 411958 - DNA, 371 bp, Homo sapiens
cagttttttacaacttgatcttcagattctgagtagtcccagtcagaatcctaggaagtcattttctgaatatcaacaaacattcaaaagtttatatggacagccaaaagacccataataaccaaaacaacactgaagaacaacaaagttggaggactgacgctactggacttcaagacttgctataaagctagtcatcaagatagtgtagtattggtgaaagaacagatagataaatggaacagagagcccagaaatagactcatacaaatacagccaactgatcttttgcaaaggagcaaaggcaagtcaatggaaaagtgatagtcttttccacaaatggcacagaactggacatccatatgcaaaaa

SEQ ID NO: 411959 - DNA, 252 bp, Homo sapiens
atttttgtattttttgcagagaaagggtttcaccatgttgcccaagctggtctcgaatgcctggcctcaagtaatctgcctgccttgccctcccaaagtgctgagatgtgcctgggcacaagtaacctttaacatgtattcttcattctaaagagagcacagttaacaatataccctgatttgcatacttgaagctctaataacattaatggctcatttgtctgcagaatataaaagctcaacaaaaaattt

SEQ ID NO: 411960 - DNA, 380 bp, Homo sapiens
tgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctcaagaactgaaaaattgggggccctacatttcatttcacaatttacttttttactacgatttgttccatgctg

SEQ ID NO: 411961 - DNA, 869 bp, Homo sapiens
aacagtgaactgatgcgttggctgttgactcagtgaagttcccacggctggctttggcaacagacctagggctagactatgttgcctggaagataaagaagcattcactgctcttcccatcccactgtattgcctggctagtgtttgatcagcttttcaatgtgcggtcaagttgttgattgagctagtaacttataagtgaattatctttatgattgtgttcatttctaaccatgtccctgtgcagtttacgaacaatactaatcataagcaaatactttcacctgggcccaatgatttttacctgtactgaccaagtgaacaacttaggctggcttatgccagtgaagtggtgcttctccctcctgacatgagacttcactgaagtgacttgccaagaagaaatgagaagatggcacgtggagagtcatgtggatgctcttctctgcctcaagctcagctctcacgtgcttgatctgttctgtctgtgtcctttaatataaatgtttaaatgtttaaatgtcattgggtacttggttataggaggaggcagagctctgagtggaatccatgatggtcctgagaccagagatatgtatttttttcttttcatgtatgtatgtcttatatccccaattgagaattctatcactgtgagtgatacagcttcagaatcctgaaggctaagctattaggtttgaacaatatgaaattgctggtttgcaactatattatatctacaaaagggcaagttcatatagcttaacctaaaaagtaaaaatcaaatgacatcaggtatgtgcaaaaatgtcataaatggctggtgaatatataagaagttcaacattactaagagccaaaaattgaaa

SEQ ID NO: 411962 - DNA, 322 bp, Homo sapiens
tcccgttcctcttatctcagtctcagttagagagagaaaggaagcgagaaggcatctatgggtttcagaggcatttagatttttttcaattgattgaacagatcaacagtataattgtgttggttcaagtcccgtaaaaatggttagaggcagagagtcattttataaaaagagtgagggacttgggatcagaaattctgaatatgagttctgtcttaatcacttgtcagacttgtaagcttcgaccagcaactcaatcatattaaagcagtagtttcatgctttattatcagaagtaatgataataataatatcgatgtca

SEQ ID NO: 411963 - DNA, 869 bp, Homo sapiens
gttttgcttttgtctcacattcagcacagctgtctgcggcccctgccggcaggtgtggccgcacctggtgtgaagtcacgtggagtcagtgctgtggagggaagtcctgtgcgggccgggcagtgaggagagcactgattcacgcctgcagaaacgtaacctcccctttccgtgtatgccttttaccatcatccaggcgactgctccatccttttaaattaggggtcctgcaagccccaagtgacccatagtcagagtatctggtttggggtaaccgagttggtcttatggggcaaaaactcaagacacttagaaacatgcaaagtacaaaataatgtgttccctcctgttaccccagcaagggtggggttgagctgggaatgacacccagtggtgtaatgagtggaaagtgctggtcagctgctaacccccctccaagcctgctgcaccttcacttctctgcatccgtctcctgagtcataactagggacttggctagatgacctcagagacctcgtccacctctgaattctctgtttttaagcccatagttcaaactttggctttgatctctgaagtcttctgggtttggaaatacgggaagtcagctttgaatccattgcttctctaaaacatcagggctagtggaactaacccacttgagggtgacctcaagggctttaggcagccatggggctggggccatactgctctcaggctgggcagtatcttcattgtggttctcagacagccttttttactcaaacatgagactttccacccaccagttagggaactttttttttttttttaaacacggagtttcactcttgttgcccatgctggagtgcaatggcacaatctcagct

SEQ ID NO: 411964 - DNA, 509 bp, Homo sapiens
agcctgagttcccatcctcagcgggcctccgttcttctctgcccgagcacgccgggggcgcagcctccgccagagctacccgatccccccgcggcgaggccccccacccggcctcaccccgcacctccactcccctctcgcgattgctccctgccaggcgcccaggctggatcctggtgcgccgcttttcggggccagcgcccctgccgccgagggggcaaggggagtggggaggacacgctcgccctcccagatgcagttattaattttaagggagtgtcacttggagtgaatgaaaatcgctcggacgcctggctgaaggcgtcgcgtcccccgccggagccccgcgccctttggtctaggccggggcgtggaggaccacgagccacctttcagcccagtccccatttcaccattttccaggcgccccagttagggatgggcatcacagtgtcagtggggggaacccatattttgaagggaggggggctaactgcggaaggtaacat

SEQ ID NO: 411965 - DNA, 534 bp, Homo sapiens
gaaaccacaactggagaaaaaggcagtgacaggccgcaggcactggcacactctggtcctgagtgaggcgcgggagcaggtgacaggcggcgggctcctcagaggacactccaggaaggagggaggtcccagctagagcaggagcagcaaactctctgcacagggccgcatggtcgctgtggcaggctttgccggccacgtggtctctgtcccagctcctcgcctctgcccttgcagtgggaaggcagccgtgggccattcggctgaccctgaacgacacgggtttcagctgcggggatccacttctatgcagattttcttccgcctctgccacccctgagatgctagaccaccccctcctcctcccccttctcctactcacaggaagacggcaaggcctttatgatgacctgcttctacttaatgtaaatatattttatcttcgttatgattttcttaataacattttcttctctctagttccctttattgtaggaatacagtttataatacaacatacaaaatatgtgttga

SEQ ID NO: 411966 - DNA, 508 bp, Homo sapiens
tagtttgcttgcttattattattttgattaaagacttactatttttgtcacatttgctcatttcctagggttatagcaacctcagtcttcctaaactgaactgatctttgttttctctggattctgtctgtacttttcatttggtcattccatcatatcttttgttttagtcttgacctcccaattagattgtaaacagtttaagaatagcacaattctttatttctcatctatgtataatgtaacagaacatttagaacaatttttacaaagttggtttttacaggtactgtatgtctgaaatgatactaggattaaactattatatatatatatataaagtgtgtgtgtatgtgtgtttgtgtgaactattatttgggaaaattttaagcacgctttcaagtagagagactagtacaatgaatccacatgcactcatactcagcttcaactaatgtgttttttgttgttgtgtcttgttttgttttgttgaaatggagtatcactc

SEQ ID NO: 411967 - DNA, 505 bp, Homo sapiens
cactttacttaatgtgcaaaattaaatttatgctgaatctgtgtgtattacctactgtgcatgaacggcatgaaatataccacaaagcaaatcagcacagagccatgctcttaattgctaatggctttcaacacacttcattgtgatctaaaccaacttggaatccattctccattgagaatcccactcatatcgaggttgaaagtgcttcttccgagaaccttctggagaactgaaggagacaatgagcaatgcttttaactcaatctttctagaacacatgttctctagatcacagattctgcacttttcactaatatcgtgatcaatacagttgctacaaagggcatggatttgctgaaaactaagcaaatcaatgtgaaatatattttcgaagtaaaataaaggaaataacccaagattcagtcctagttctgaaactgccagtctatgggactggctctgagtgtctggttccatgcattaaaacttaataattggaata

SEQ ID NO: 411968 - DNA, 2554 bp, Homo sapiens
tttttaacatccaggagatattctaatacttcttattttccaagtacacacaaattgggggtagggggaagggctaagatgcttaatagtgggcgtacgagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaacatgtcttgtatttataga

SEQ ID NO: 411969 - DNA, 1241 bp, Homo sapiens
cggacgcgtggggaaaaataatgaattcctaattagcaactcctaattcactagggattctggttgtcacttttcttagttatgagttttcggttaagagttttttgatacacgatggcgctgctgattcatcagtggtcgtttgagtttttttcaagagtgagaagggatttacatcactctttccatgctctgatatttttatgtgattctctctgttgccagcagtatgctaaagtaaggtggtgctcttttggggctaagcatgcagtacctgagaaagatcaaagtgacttgaactgtttggaaagtaccctgaccttaatcttgttagctttggtgcttagtttgttgagcttaaccattaataccaaaataatactcatgccagactttagtgaaaaggcagatggcaagactgaaggtaaatgaataagttattaaacatgtcatttttgaaaaaggatcctcattcccttattagaaagcattattgaacttttgctgtcacataatgctaaggacatgttttctcttccttagcttatttgtagaaaagcttcctaaccatcgagattaccagcaatgtgcagtacctgaaaagcaggatattatgaaggtattgtgggttttcttctccactgtggaatcaaatgctccataagtatccattattgattcacccttccccttcctcccctttctctttctcttgagagtttgagcgcaagaaattcattccattaactatgatgtttcgattttttcttagacatttaatgatcatcactgagccagtgtggtttgtctaattgatgctgggggaaaagaaagaaatacgttacctaatagtgtgaggaaggaattattttacaataatctctcccagaggttaagagaatgttgtgtatttctgcgaacttctttcagatggtcattttggctgcttttgattattttatacagccctgaactcaataactgtttgaaaattagtgttagttattaaggcagccacaaagttctagctatttacatcttataggactggaattatagattagaaagtgttgtgggggaagcaggaggtggtagactaaaatactataaaggaaaaagagtgttgcaatttatcatcaattttttaatgatttatcaccaataattgctatatctataattttggttatgtctagctgtgaatatattcttttaaataaacatttacaatgtttcccatt

SEQ ID NO: 411970 - DNA, 2354 bp, Homo sapiens
  misc_feature (1246)..(1246): n is a, c, g, or t
actatatgtgctatcaaagtgagaccccatttatcttttaatctgtttctgattgtttttccagtgtctacttaactgagactcttacaggtaattttgtaggatactaggtgttttagatggcaaatataaagattgtgtttgtgtatgtgtatgtgtttatatgtgagggccaatctattgaaaagaaacactgcagaatactaaagcaaaattgaaaccatttagagtttgtagttgttttattttaaaagctaaccttgtaagtacttagtctttcaaaaaataattttaacttctatgttttatttttctattttaatttttcctgggccttgcctcccaatcctctcaccttccctttcttctgtgtgacctatagattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattaggtaatccaagaattgccaggcgaacaattgtgaaaatctttcatagagttcccgatgaaaacaactctttcttgttagccattatctctgcctttcctttctaaagaaaaacacgtcatttcatcttgattatcagtttctcaagtactcatggatgtgaggccaggtaccctgtcaccttggctctgtttgggatgcaatgttgtgtttgtcaccacttcccattccccaaaagcatctttaacatagaccattcattcttcagattcaaaatgcttaagctgaactaacctcaaagggccctcattaatttacagacatttgaataacacccatattcatttctgctactgaaccaaagccttttccaaaaaaatcatctagcaaactgtttttgccaggccaaatattaacaggtatatatatttgcatacataaatatttacctctatgtcttgtgtgtttttgttatgagacagagtctcactctgtcgcccaggctggagtgcagtggcacagtctcagctcactgcaacctccacctcccaggttcaagcgattctcatgcctcagcctcccgagtagcgaggactacaggcgtgcaccaccacgcccagctaatttttgtatttttagtagagatggggttttaccctgttggccagggtggtctcgaattcctgacctctgatgatctncccgcctggacctctcaaagtgctgggattacagacatgagccactgtgccctgcctctgttttgtgtatttacataaatacatgtctccagagctttaaattcttcttaaattttaaaactagaactaaaccagacattgagaggacccagaaatataccctgactaacgtgggtggaatttcatttggcttgactctttggtgaaaaaaaaaaaaatcaggctctcaaggactcaatttggtgaaccaatgccaaatagaaaaatgttcttgacattttccccaaaatagatgtctaaagattttgcacttcaaattggtactttatgtattaaaagtgatattgaaactaaattcctacccaattagttgaaaaatatgaaaaaagcaattgctagagaatgcaatttattaaatgttggtggtcttttaaaaaatgaattcctcttgtagccagtgagatcagttatttatttatttattttaatagtaacaaggtctcactatattgtccaggctgatcttgaactcctggcctcaagctgtcctcccatctcagcttcccaaagtgctgagattataggcatgagccaccatgcctggctagttaatggttattaagtaatacaaacatttctgtgaattccaccagatcattgactttggcatagttcacttaagactttgtttgataaaataaatctctttcactctaattaggaagcatttttgggatcctgattaatgctctaatattgtggggccaaaaaatatgtggaacgtggccctgcagttagatgagctgagatcactatagtactatatagcgctctaaatcctaaatgctagatcactgtaatactgtacagatcagccacttgctggcttgtgactctgggccatttacttcacctctcaaaaggcatatttaaagtgaggaaaataataagtttattttggaaattcagttagatgatgcaaattgtttactgtaatttctagcatgtagttcgtgctccatgcatttaactgttattacaggttgtattagtatcacattaaattacccactgaagtgaaagtgaaaccagaatgctgtcaacgatt

SEQ ID NO: 411971 - DNA, 2416 bp, Homo sapiens
tttttaacatccaggagatattctaatacttcttattttccaagtacacacaaattgggggtagggggaagggctaagatgcttaatagtgggcgtacgagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaacatgtcttgtatttataga

SEQ ID NO: 411972 - DNA, 766 bp, Homo sapiens
aacatttcatttcctgttcagttattttttttttttctgtgagatgcatgtcattctttctgctattgttttttagacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaacatgtcttgtatttataga

SEQ ID NO: 411973 - DNA, 4187 bp, Homo sapiens
  misc_feature (3079)..(3079): n is a, c, g, or t
tttttaacatccaggagatattctaatacttcttattttccaagtacacacaaattgggggtagggggaagggctaagatgcttaatagtgggcgtacgagttgtggataaatatcaaaaagggaatcctaacatgaagtataagtgggattttcaccaaaaccctatccttccccagactccagtgacagtttaacggtcagctgcatcaaggcttgtgtactgtgcagtcttaaaaggcaccactcctgtccatctcggtgaaattgatggtggagcaaaagggagtttaggtggttccggtctggggagaagacgtgcagggtttcagatgcgaaagtcgcacccaaccgcttcactcgggctctaggccatccgcaggggccctgcttccttccacctgcgagctttttctgcagaatgcgggaagccgccgccgccgccacagaggagggggcggaggcagaggcggaggcggcacccaggggccggggcaggggaggccgggaccatcgcagtgacaatttattttcctgcagcagcggcagcagggacggttgctgcaggttcggggtcggccggcctgcgcgtgggcttgcgaggacgctgttcgtcccctgcgctggggtgtccgacagcgaggaggagaacgacgcacggagcccgcgcgactggaaccagcaaagctccatctgtcggcagaggagaagggggaggaggcacggccgaggcaaacgagcggacgcctcgtcgccgggtgccggtatcaccccgctgcaacgccttccagcaaaagccaccgcggcccgggttgcagcagccggacggatgccaaggccacacggcagccacgggggcagccgtcgcagtcgccgtcccacacgggctgcggacaccaagggttgctaatgaagtgattgagaagaaacagtgaacatcctcatttcacagataagacaacatggatcagccttttactgtgaattctctgaaaaagttagctgctatgcctgaccatacagatgtttccctaagcccagaagagcgagtccgtgccctaagcaagcttggttgtaatatcaccatcagtgaagacatcactccacgacgttactttaggtctggagtagagatggagaggatggcgtctgtgtatttggaagaaggaaatttggaaaatgcctttgttctttataataaatttataaccttatttgtagaaaagcttcctaaccatcgagattaccagcaatgtgcagtacctgaaaagcaggatattatgaagaaactgaaggagattgcattcccaaggacagatgaattgaaaaacgaccttttaaagaaatataacgtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtattcagaaattcctttctgggataatttctggcactgctttggagatggagcccctgaaaattggctatggaccaaatggattcccactcttggggatctctaggtcatcatcaccatctgaacagctctgagagagacaagaagtggaatggagaaggtgattaggtaatccaagaattgccaggcgaacaattgtgaaaatctttcatagagttcccgatgaaaacaactctttcttgttagccattatctctgcctttcctttctaaagaaaaacacgtcatttcatcttgattatcagtttctcaagtactcatggatgtgaggccaggtaccctgtcaccttggctctgtttgggatgcaatgttgtgtttgtcaccacttcccattccccaaaagcatctttaacatagaccattcattcttcagattcaaaatgcttaagctgaactaacctcaaagggccctcattaatttacagacatttgaataacacccatattcatttctgctactgaaccaaagccttttccaaaaaaatcatctagcaaactgtttttgccaggccaaatattaacaggtatatatatttgcatacataaatatttacctctatgtcttgtgtgtttttgttatgagacagagtctcactctgtcgcccaggctggagtgcagtggcacagtctcagctcactgcaacctccacctcccaggttcaagcgattctcatgcctcagcctcccgagtagcgaggactacaggcgtgcaccaccacgcccagctaatttttgtatttttagtagagatggggttttaccctgttggccagggtggtctcgaattcctgacctctgatgatctncccgcctggacctctcaaagtgctgggattacagacatgagccactgtgccctgcctctgttttgtgtatttacataaatacatgtctccagagctttaaattcttcttaaattttaaaactagaactaaaccagacattgagaggacccagaaatataccctgactaacgtgggtggaatttcatttggcttgactctttggtgaaaaaaaaaaaaatcaggctctcaaggactcaatttggtgaaccaatgccaaatagaaaaatgttcttgacattttccccaaaatagatgtctaaagattttgcacttcaaattggtactttatgtattaaaagtgatattgaaactaaattcctacccaattagttgaaaaatatgaaaaaagcaattgctagagaatgcaatttattaaatgttggtggtcttttaaaaaatgaattcctcttgtagccagtgagatcagttatttatttatttattttaatagtaacaaggtctcactatattgtccaggctgatcttgaactcctggcctcaagctgtcctcccatctcagcttcccaaagtgctgagattataggcatgagccaccatgcctggctagttaatggttattaagtaatacaaacatttctgtgaattccaccagatcattgactttggcatagttcacttaagactttgtttgataaaataaatctctttcactctaattaggaagcatttttgggatcctgattaatgctctaatattgtggggccaaaaaatatgtggaacgtggccctgcagttagatgagctgagatcactatagtactatatagcgctctaaatcctaaatgctagatcactgtaatactgtacagatcagccacttgctggcttgtgactctgggccatttacttcacctctcaaaaggcatatttaaagtgaggaaaataataagtttattttggaaattcagttagatgatgcaaattgtttactgtaatttctagcatgtagttcgtgctccatgcatttaactgttattacaggttgtattagtatcacattaaattacccactgaagtgaaagtgaaaccagaatgctgtcaacgatt

SEQ ID NO: 411974 - DNA, 1229 bp, Homo sapiens
ggacgcgtgggtcgacccacgcgtcggtagaataccaagaatatttgcaaagcaaaaacaaatataaagctgaaattctcaaaaaattggagcatcagagattgatagaggcagaaaggaagcggattgctcagatgcgccagcagcagctagaatcggagcagtttctgtttttcgaagatcaactcaagaagcaagagttagcccgaggtcaaatgcgaagtcagcaaacctcagggctgtcagagcagattgatgggagcgctttgtcctgcttttccacacaccagaacaattccttgctgaatgtatttgcagatcaacctaataaaagtgatgcaaccaattatgctagccactctcctcctgtaaacagggccttaacgccagctgctactctaagtgctgttcagaatttagtggttgaaggactgcgatgtgtagttttgccagaagatctttgccacaaatttctgcaactggcagaatctaatacagtgagaggaatagaaacctgtggaatactctgtggaaaactgacacataatgaatttactattacccatgtaattgtgccaaagcagtctgcgggaccagactattgtgacatggagaatgtagaggaattattcaatgttcaggatcaacatgatctcctcactctaggatggatccatacacatcccactcaaactgcatttttatccagcgttgatcttcacactcactgttcctatcaactcatgttgccagaggccattgccattgtttgctcaccaaagcataaagacactggcatcttcaggctcaccaatgctggcatgcttgaggtttctgcttgtaaaaaaaagggctttcatccacacaccaaggagcccaggctgttcagtatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaacatgtcttgtatttataga

SEQ ID NO: 411975 - DNA, 593 bp, Homo sapiens
gtctctactaaaaataaaaaatcagccgggtgtgatggtgcacacctgtcatcccagctaccgaggaggctgaggcaggagaatcgcttgaacaggatctcactctgtcagccaggctggagtgcattagtgtgatcatagctcactgtagcctcaaactcttgggctcaagcgatcctcccacctaaccctgccaaagtgttgagattacaggagtgagccattgcactcagccaagaagacacttcttatagaagaaagccttggggtacatgccataacaaatctggaaccatttgatctatagtgccaatagttcctagttaccttaatagctcctgacgtcagccaggtgcagtggctgacagcctttgggaggccaaggcaggcggatcacttgagctctggagttcaagaccagccagggcaatatggtgaaaccctatatctaccaaaaaaatacaaaaattagtggtgtgtgcctgtggtcccagttactgaggaggctgaggttggaggatcacctgagcccagggaggttgaggctacagtgagctgtgatcatgccagtgtcctctagcctgggcgacaga

SEQ ID NO: 411976 - DNA, 1490 bp, Homo sapiens
gctcagcccacttgcacccaagtgaataaacagcctttgttgcttacacaaagcctgtttaggtggtcttctatacggacacgcgtgacacccaggagttcgagacgagtctgggcagcatatactgaggggaaaaaaaagccttctttccttgggaaatgcaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctacttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacatggagagaaaccg

SEQ ID NO: 411977 - DNA, 988 bp, Homo sapiens
gctcagcccacttgcacccaagtgaataaacagcctttgttgcttacacaaagcctgtttaggtggtcttctatacggacacgcgtgacacccaggagttcgagacgagtctgggcagcatatactgaggggaaaaaaaagccttctttccttgggaaatgcaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctacttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccaggactcggtgaccttcgcagacgtggctgtgaacttcaccaaagaggagtggaccctgctggacccagctcagaggaatcttacatgaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacctgccggccgcggtggctcatgcctgtaatcccagcactttgggaggccgaggcgggcggatcacgaggtcaggagatcaagaccatcctggctaacacggtgataccccgtctctactaaaaatacaaaaaaaattagccaggcgtggtggcaggtgcctgtagtcccagctacttgggaggctga

SEQ ID NO: 411978 - DNA, 343 bp, Homo sapiens
agcatgagtgaggacatcttccctgaactctcgtatcttacatgaaatgtgaaaaaaaaccctgtgaaggtaaagtctacagaaagcctttcatcttcattcatcttgagtagacatttgttctcaccctggagagaaactgcgaatctaaaaggaatatgacaaagccttcagcgtggtctcaaattcatggttcatacaagaactcacactgcagagactccttacggaaataaaaaatgtaggaaagacccaccgcgcccggccacaacctcatcttaattcattgacatctgcaaagactctagttcacaaatcaggtcacctttgcaggtaccaaggg

SEQ ID NO: 411979 - DNA, 1628 bp, Homo sapiens
gctcagcccacttgcacccaagtgaataaacagcctttgttgcttacacaaagcctgtttaggtggtcttctatacggacacgcgtgacacccaggagttcgagacgagtctgggcagcatatactgaggggaaaaaaaagccttctttccttgggaaatgcaggaagccagcaagcggccggagtctccggagcccgcaaggaggcgcgttggctgcgcagagagcgcgcttcccagctggagagcctaggaacggtggcgcgggcggaggcgacagcgaggacccaaggctggggtttcctacttggatcaggagtgcctggggatttgatccccatcctggtgcagctccgagacgctcctgggctgcgcgcgcttttgggctgcgccaccgacagagacatctggaagccggagctagtggaagactctgcctcacctgcctccttgaaggaaacacggggaagccaggactggccgtcacgttggtgacaaatatgtcccagggtcttgctctgttgcccaggctggactgcagtgggaggatcatagcttattgcaacctccacctcccaggctcaggcaatcctccctcctcagcctcccgggtagctgagactacaggcacccgcccacactcacgggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacatggagagaaaccg

SEQ ID NO: 411980 - DNA, 1192 bp, Homo sapiens
tgctgggattacaggtgtgagccaccgcgcccggccacaacctcatcttaattcattgacatctgcaaagactctagttcacaaatcaggtcacctttgcaggtaccaagggttaagacctcaacctacctttttctgtggagaaaggggtcacagttcaaactgataacaggacacccctccgagccaaactgcatgtgttattttaggactcggtgaccttcgcagacgtggctgtgaacttcaccaaagaggagtggaccctgctggacccagctcagaggaatctctacagagacgtgatgctggaaaattctaggaacttggcattcatagattgggcaactccatgtaaaaccaaagacgcaacccctcagccggatattcttcctaaaagaacatttcctgaagccaacagagtgtgtctcacgagcatcagttcccagcactccacattaagagaagactggagatgccccaaaacagaggaaccacacaggcagggggtgaataatgtgaagccacctgcagttgcccctgagaaagatgaatctcctgttagcatttgtgaagatcatgaaatgaggaaccactctaaacctacctgcaggcttgtgccttcacagggagattccataagacaatgtatcctaacacgtgactcaagtattttcaagtataatcctgtcttaaacgatagtcaaaaaacacatgaaaacaacgaagacgatggagtcttggggtggaacattcagtgggttccgtgtgggagaaaaacagagctgaaatcaagcacatggactggcagtcagaacactgtgcatcatatacgtgatgaaattgatacgggggccaacaggcaccagcggaatccatttggaaaagctttccgtgaagacggatcccttagggcacacaacactcatggtcgagagaaaatgtatgattttactcagtgcgagaacacctccagaaataactcaattcacgccatgcagatgcagttgtataccgcagagacaaacaagaaggattgtcaaactggggcaacctctgccaacgctccaaattccggttcacacaagagtcattgcactggagagaaaacccataaatgccccgaatgtgggagagcctttttttatcagtcattccttatgagacatatgaaaattcacatggagagaaaccg

SEQ ID NO: 411981 - DNA, 444 bp, Homo sapiens
ttagggatcacatagctcagtaggtgagcccagcagtttctgggtgggggagggcgctgagtgagccagcagtggagaggggctggacaagatccgctgatcacagaagaggagagggaggttctgagtgacccacagcacactccacacccttggaagatggagaacccttcctagccccccactgagtcctggaggcagccagtagaatgttctgggtctgagacccaagtcatttttcaccctgatcctgccctctccttggtagctctcagaactgactcctgagggaaggcaagtgtttgaattgactttctccaaggttctcactcttaggaagatgcaggtggagttatctgtgattctccctgtaggtcaggtgagtcctcaaactgcttccctcatggtgataaagtggctgccaacaccttccaggccacatgt

SEQ ID NO: 411982 - DNA, 833 bp, Homo sapiens
cccccgcggtcgaaagaaacccagagcccaccgctacaccgaggtctagatataacaacagaaaacccgaccaaccggaagacccgaacacaacaagtgatccatgcagcttatatccgccatccaaaccagtaaaataattgatgaacaggaagcaaaggccacacctattcgccgaggcatcacctggatcctacagagtcagccttggccatcagtgatggtgaaagcaacagatgtcagatgtcagcccctggcttcctgccttaccgtagagggatactcgacagactggacaggcctcactctgtcacccaggccggagtacagtgatgcaatcatggctcactgcagcttccacatcccaggcttaagtgatcccccaacctcagcctcctgagtatctgggactgcagctgttacctactttctctgctgggctgaagagcgtcgggtgcaaatcacagccacgatgaccactaccagcactgtgatgacaccaacggtgaccacaatgatcacaagcaggttgctgttcttctgaggagtgacactgccatgcggggggtgcatttgtccaattggcggctctgggaaaagacaggaaaatggagttcaggtttaggaagatgtggcagaagttttaccaagctctcttgggatatacaaagttcctaatgttctgggcttttctgaacttaggggtagtgatgggagttcgagggaagcaatgaaaaaatgagaggaaacacctatttacacaatataaataaacccgtatgcgcccaccccccctgttttttgtgtcaatttttagtcggaacatgaagcag

SEQ ID NO: 411983 - DNA, 456 bp, Homo sapiens
gcccgacaattacaccgactagccaacatcataggactcctgcaatccaggccatcgcaggccaaggtttttgaaggaagccctcaaagaaaggaagacccttttattatctggattcatccttggccatcagtgatggtgaaagcaacagatgtcagatgtcagcccctggcttcctgccttaccgtagagggatactcgacagactggacagatcactcatgctggggaaagccaggtgtcatgtcttggggaatccaggtgttatgtcttaaggacaggctggcagacctgtgcatacgcccatgtagcgagaaactagaccctcagctcaagacactgaaagaaacctcatgaaacaacttgaagctctgaccctgaaccacctagctaaactgctcttagatacctgattctcagatactattgagaaaataaacaataattattttatgt

SEQ ID NO: 411984 - DNA, 444 bp, Homo sapiens
gcaagttaaaggaaccggccaaaactgcagagggagaggctgaaggctgtcgcgcctgcctggtgtccttaagcaatccaagtcctcagtctcccgggtccgccccttccgccgcgggcggcagcttccggctcgcgcatgcgcagtgttcgcggactcgccgccaacgcccagtacagtcggggacgagtccaagaggccctttgccaattccaactggaacatccaacatcggacactaatccagccaactgccataactacagctttgattagacaagagactgatttcaacaactttctcctgataagaagatcatggactatggaatggactggttctggtttacagaggctgtgtacttgcgtgccttgatgtcctgaaagaccttttgacagatagggcctaatggtaatacatttaaatgtcaagtcaccatccca

SEQ ID NO: 411985 - DNA, 317 bp, Homo sapiens
tgtggtttcactgctgttcaagggctctgttttgactgcaagaagagacactacgtagaagaataagtacataaaataagctgcattcatactaagtgagcatcaacaagcacctcttgatctctaagacagcaaaccaaaatcattacatgcaataaaatggaagcaaaatccttttatagaagacaagcaccgtatttctcaaccaaatgcaagcttacacaccaaatgttttgatttcaaaagaaacaatattttaatgtcctaggttgaagagttttgtgggattattattctgtatcttcaaagtaagtgag

SEQ ID NO: 411986 - DNA, 488 bp, Homo sapiens
catgacagaaatgtctgtgagatttccaaggctaggtcacaaaaggcattgctacttctgtcctcatctcttttgaatcacttgctctggggaaagccaaatgacacgtcttgaggaaacccaagcagtcctatgaagaggctcatgtggtaaggaactggggcctcctgccaacagccatgtgaatgcaccaacttggaagtggatcctccagccccactcatgccttcaggtggccacagctctggccaacatcttgatgcaaccttatgagacaccttgacccagaaatacccagctaagctgttcctaaattcctgatctacagaaattatgagataataactgttgctttaagctgctatgtgttgaggtctactacttagacactttgcatagactcttacttctttcatcttcagaatgaaaatgataaaatttaccttttagagctgtcgtattaaatgagatatataaaaagtgccaaa

SEQ ID NO: 411987 - DNA, 548 bp, Homo sapiens
gatgcaagaaggagaggtaagcaaagaaagcagtaaactggtgtgtaatcaaacactcagctcataaaacataataatgtctccatatgtgtgtgtacattattttggtgcttatgtttacaatataatttagcaggatatacttaagttatcaaagtctaaatagtatttttatttcctgccaatgacattggcatacttcaacactaatcacttctaccaacttaaaagctattgctgtggtatttttaaaatatatattagtgtgtgtgtgtatatatatatatacacttacacacacacatacatatagatatataaccagattataccacaaagatagcatgtaggttggtagaaacaatgcttggtgctaaagtattctaacatcattattttgctgggcaggaaaaatgttttgttcacacattgataacttaagtatgtcctgttaaatattttgcaaaagtactaaaataatataaatagaatgcatattaccccaaagagtagcagaaaaggttggggagggggaaccaaactgaaga

SEQ ID NO: 411988 - DNA, 380 bp, Homo sapiens
aagcaactcaccattagagagatgtattgctggctcttccaagaaatggagtggaaatctttctgtgccactttgcccaggaccattgtgccagtgtgcaagaatgtgtgtttttcataaacagaaaaatatcactagctgcaaagagaagaaactgttccagggtgtacaaatcccacgccaacctccaaaataatggcaaatactgttctgatcttagcaacccagaataacctttgtgccatttatttattcaacacatatttcttgggcagctattatgggtcaggcactgtgctaggcgatatgatcatgatctctgccctggaaaagcttcatcttacatatctctggaataaaatattttggtggaatagaaa

SEQ ID NO: 411989 - DNA, 2266 bp, Homo sapiens
  misc_feature (286)..(286): n is a, c, g, or t
ttttatatgaatgtagaacaaatatcaaacaggattatacagtgtgatagtcaggaaagtagcatgcttttgtgttttatagactagtctaaaaggagccccagtagacttggtattgttaaaccaaggagatcttgagaactgttctgtctcccttgtgcccatagaattgtagcctgtggaggtgaccaaggaaccagatcccaagaggcctctgccactgaaaggagatttttattacttgcgtttcctagacgggggggcactcgcgccaagcaggcccacngggcacactggtgtcagtcaaggggcagaaaggagccacaggaaagcccaggacagagcctgagtggggtttctgtgggaaaggcagggcagggcacccgtgtaggaatggctagtgtgaacagttccagtgggccctgggctgtaggagagatcactagctgcctgctaccaggccctggggtgatttcgggcaggcgggcagttagataagggaggtgggtagagccgaccacctgcctggaaccctgtgctggctataagccctgggagggccagtctctccctgtgtctgtaaggcccacaaatgccaaagcattaggaataagaaaatggacgtaatagaattgatcctgtgaggactggatgcctaactgccacatacagaatgtgagaaagcacagaacaactgccttcattgacaagatggtgcccagagctcaagacaggcacacagcaggaggatgccggcaggatccctcaacaagcttaccgtggtatctttcacaatgttaactgtcatcccagatgaacttttaatgacagtgtatctctgaagattgtgcttttagcgtattttcacttaaagtcatatctcatttagtagacctgccagattcctgaaaagttacacacaagccagctgacatgacctttgccagtcatgttgaccacgttctcaccgagctgtggactcctcactaggagcctttacctacggccagatggctgttgtcactgcctgtggtggggttacggtttcggactcacctgatccgttctgccgggattacctacggccagatggctgttgtcactgcctgtggtggggttatggtttcggacgcacctgatccgttctgccgggattttaaagtatgggagtttaggcatactttgcaagttgtttcttgaatatacttttctgaattatggcttgctatacaagttttggtcttttaaggtaagagttacaatggagatggggaaattatacttttctcatttcaaggaaagcaacagtcatgagttatgcatcagttgggaaacgggatgataggaagttgcaaggcaacctggtttcagccggaccgggactctcccggggctgcgtcctgctagagctggcaggacacagaataccactagcagcctccctgggagtggcttggcgtcttggccacctctttccacggatgtggtggatgtgggggtaaactagagagactaaagcccactattgggctcagcttcctgtagaaatcaaatcagatgaaaaccctgacccagagggagaaggcagagagttggacttttgaaaacgtgagtgtgtccagcaaccaggcagcaacagtccttgtttttatcgaacttctataagcactttatttctccagaataatttcatcataaagaatccagagctcagacagctctttaccatctgtcttttccttttttcttaccctgtgtttggcttgatctggactgcacttaaccatgacaatgttaagtgctttcttctgggtaaaaattctggcttcttctccagaaattctggctccacttctcaaattgtttctgtccctgttaggagacccctggggcctcggctggagagacagtgcagctagtcccagcagccactgtgcttgggcctggccagcccctcctcaggggtcacggcactgctcacctggtgactaggtcttctcagccagatcagttcatgtgctctggtgtttttgagcttctggctagtcctcagtttctcagacctggttaatcacagtgtggagtcatttttcataactgtgcacctcacttgtttgatgcatggcaagggaataattaaattaataaacctacagatattcccccttacagttttcaaatacagtaagtgaatttctactataaaataggtccaaagaggttttattgtttcttatttgaaataattaaagaacatttatgtttc

SEQ ID NO: 411990 - DNA, 199 bp, Homo sapiens
caaggtaaaagctttttattgccacaagaaaatgagacacccagttcagtgtttcagtaatagacatctgtgctagatactgtgggggacacggtagaataagctcctgtcctcataggtcttaattctgatgaggtggtggttctaacacataaaacaagagccaagtcctccctgtcatggtagttggtgcattttg

SEQ ID NO: 411991 - DNA, 332 bp, Homo sapiens
ttttagtgcgtatgctctaactgctgccacagaagggatgcagaggaagacggtcagttacccagagggtgatatctttgacttaatgttcaccataaagacagctatcaacaaaagacttgaattctaacttgttatctattgcaggaaagtgcctgcaatatggtgactcctgcagagcacctgacaatcagagaagagttagaatacattaagctcagcatcacatatgtagtttgaatacaactccacctccttctctttctttctcttctttcctgcctttgttgccctacccaggattaaaaccttaggtcttatgttaaaagaat

SEQ ID NO: 411992 - DNA, 508 bp, Homo sapiens
ttattggttacaaaggagtaatgaaaaactcttagaattagataatggtaatgttgcacaacatggtgagtataatgattgccactgaattgtaccgttaaaatggcaaattttatgttacatatattaatagttttaaaaattagtaatttaatgtatcaaaaatctttgaactgtatacttacaatgggtaagttgcatgatatatgaattgtatctcaataaagctgtttaaatttttttttttgagatggagtctgcatgagccactgcgcctggccaaaaatgtaaaaaataaaaaaatcaattgtatttctattgtatactcattggttttgtagtaccaatgagtacaccaaatatgaaattaagaaaacaattaagaaaacaattccggccgggcacagtggctcatgcctataatccaagcactttgggaggccaaagcggacggatcacctgaggtcaggagcctgggtgacagagtgaggctctgtctcaaaaaaaa

SEQ ID NO: 411993 - DNA, 436 bp, Homo sapiens
agatttagtttgattcaaacctgctgataaaacaaatgcttatatgcaagaaaaactagcagcaagatatgaataaatctccccattatgtagttaaaaactaatcagcatgacacatttatatttaggtatttcttctgcagaggattgccagaaatttcttaatgagagtgataatttggtgatccacctatgtaccttttgatgtctcatcacagagattagtgcttcctctgataatacatttgcttgatcctgctaataagaactcacctttctttttaacgaaatcaatttgtgttaatttacatagggaaaaacgttccttgagagggaggagaggggtgtttaccacccacaggagcagttccatccctggttacccaccagtatccctgccagatgttagactggaattagaatgaaaatttaaaaa

SEQ ID NO: 411994 - DNA, 758 bp, Homo sapiens
  misc_feature (5)..(5): n is a, c, g, or t
  misc_feature (81)..(81): n is a, c, g, or t
ggctntatctgggaaccacagacagaatcatggaactgaccatcttcagtctcaaagtgctgccctcaccactacacccangggcaggtggtcttcgggggaaaggcggttccagttccttctcccaagccagtgaggaagtcaatcctgcgaacaactgcaggaacggccttgggagtggatccttcctcagcccggctccaagacaactgcagccctgtgagaaaccctgagtggaggaccaagccaagcctcaaatcgtgacttggaactgggagacaacagatgctgttggaagccactgagctctgaagtagtttgttacacagtgacagaatctaggatctggggaaggtaaactgaggccaccagtaagcatgtgctccaggccaaggctgagtctgtgctgcatccatgtcatcagccacccaagaaaaaccagttactccacctagctcatggtggcggcatcctccctgcaatggtgcatggggggcagtcctttcccctgcagggtgtcattgccacccccatcctcatcctggaggccagtccaggctccgatatgagtgactaggggtgaggtaggggtggcagaagggagatcaaactggagcattccagatgcctactactgccctcacacaacggggcaactgtgctctccaactcctccccttggcagagaaactggtcctgcagtttcaggactagacgagcgtggggtagtggcaataaaggggcttgtatgagaagtg

SEQ ID NO: 411995 - DNA, 1013 bp, Homo sapiens
  misc_feature (5)..(5): n is a, c, g, or t
  misc_feature (81)..(81): n is a, c, g, or t
ggctntatctgggaaccacagacagaatcatggaactgaccatcttcagtctcaaagtgctgccctcaccactacacccangggcaggtggtcttcgggggaaaggcggttccagttccttctcccaagccagtgaggaagtcaatcctgcgaacaactgcaggaacggccttgggagtggatccttcctcagcccggctccaagacaactgcagccctgtgagaaaccctgagtggaggaccaagccaagcctcaaatcgtgacttggaactgggagacaacagatgctgttggaagccactgagctctgaagtagtttgttacacagtgacagaatctaggatctggggaaggtaaactgaggccaccagtaagcatgtgctccaggccaaggctgagtctgtgctgcatccatgtcatcagccacccaagaaaaaccagttactccacctagctcatggtggcggcatcctccctgcaatggtgcatggggggcagtcctttcccctgcagggtgtcattgccacccccatcctcatcctggaggccagtccaggctccgatatgagtgactaggggtgaggtaggggtggcagaagggagatcaaactggagcattccagatgcctactactgccctcacacaacggggcaactgtgctctccaactcctccccttggcagagaaactggtcctgcagtttcaggactagacgagcgtggggtagtggcaataaaggggcttgtatgagaagtggctttcgcctctcatccctaggggcaaaaagtgaatcatctaactggtccaagtcactaatggcaatccttcttccccaagaagactgagtttcctttgtcacttcaggaagggaagaagagaggttagctgagccacccagattaggcccagatttagccaccacctagaacagggcaagctggaagtgaaagaacttgaaatactgactttttccttcttaaaaaagacctaacattgtaatggtttagcaaa

SEQ ID NO: 411996 - DNA, 351 bp, Homo sapiens
tctcttacgaacacacccacacagagaaactccaacaagaggctctagagaagaaatgaattttaatagacgatgctttttaaatagccctgctaacgttgattaagtcctctttattacaggctctttgtagagagatccacggagagggcctccaactttcaatcgaatcttccacaacttgtatttatcgtgctattaattatgtttcaccgcagttgactactgagaacttgagagctaagctcaacagaaaggatccttgaccttaaagtttacaaccaaagccacttgtcctgatttgcctctttggacttaagaggcagaaagaaaaacatgtataaaaggtat

SEQ ID NO: 411997 - DNA, 454 bp, Homo sapiens
ctaatataaagttattttaaagttttgtaacaaaagcattttccaagtttatagaatttggttgtcatgttctagttctctatataaaataccttgccaggctcagcaaaagtcatatttggatttgctaccatcccttaatgaggacataggtcattattaaaactatcagacatgcctgaatacaagatgacctaagtggaagccatgtggtcttttatgacccagcttcaaaagtcaaatataatgtcatttctgccatcctctatttgtcaaagcagttacaaatacccagattcaagaccttacctctcaatgggagcagtgccaaagaagttgtggcttttttgtaaaaccaccataataagccatgtcatatccatagaatgaaacaacatgatgctggaaaagaaattattaaactctatatacagttatggaaagatacactgta

SEQ ID NO: 411998 - DNA, 466 bp, Homo sapiens
ctctcattagctctgtattaaatatatcctttacttttagtaaatatatattttattctcttcagccatcactaaaagttgggcagaaaaaaagtgtgcaggattttctggttggggcaggaaacttatgaatgttctgttggcattcaaaactagatgtgtttaaaaggtcaatttgccaggcgcggtggtgcacgcttgtagtcttagctacttgggatgctgaggcgggaggattgcttgagcccaggagttctgggctgtagtgtgctatgccatttgggtgtctgtactaagttcgatatcagtatggtgatctcccgggagcaggagaccaccaggttgcctaaggagggggtgagccagcccaggtcagaaatggagcaggtcaaaagtcccgtgctgatcagtagtgggattacatctgtgaatagccactgcactccatagcaagactcagtcttta

SEQ ID NO: 411999 - DNA, 417 bp, Homo sapiens
ttctgagttctggcattagttttgttttcaaagtaatgaccagcactccaagcctggatagccttgctggagaactttccacctggagccctgcccatcggccctgcgggacttccttcagctcctctgtggataaggccgccaggacttcactttgtgctactgcaagtgcatcaaaaccaatattgtgtctttggcattcgaatccatgaacttctggaagagaaaccaaaaagccatgtcaggtatggctggagcctgcattttcatttgggagcagaagcatgtcacatagtcttctaaaaagagaaattttgctttaaaaatgacacaacaaaataaaatgctgactgagtcatggtaaaaagcagtctttgaatttgaataaagtgtagcagtgctgcaaaggcaaagaaa

SEQ ID NO: 412000 - DNA, 349 bp, Homo sapiens
  misc_feature (42)..(42): n is a, c, g, or t
atatatttttttgaaatattatcatctcccatttaattatcnttttcacatacctagttaaaggataaggccgccaggacttcactttgtgctactgcaagtgcatcaaaaccaatattgtgtctttggcattcgaatccatgaacttctggaagagaaaccaaaaagccatgtcaggtatggctggagcctgcattttcatttgggagcagaagcatgtcacatagtcttctaaaaagagaaattttgctttaaaaatgacacaacaaaataaaatgctgactgagtcatggtaaaaagcagtctttgaatttgaataaagtgtagcagtgctgcaaaggcaaagaaa

SEQ ID NO: 412001 - DNA, 366 bp, Homo sapiens
cagatgaactaacagtgcttaaatactgaacagaaagaagaggtaactgtaagaatcgccctgggaatgcctaatccaaggataaggccgccaggacttcactttgtgctactgcaagtgcatcaaaaccaatattgtgtctttggcattcgaatccatgaacttctggaagagaaaccaaaaagccatgtcaggtatggctggagcctgcattttcatttgggagcagaagcatgtcacatagtcttctaaaaagagaaattttgctttaaaaatgacacaacaaaataaaatgctgactgagtcatggtaaaaagcagtctttgaatttgaataaagtgtagcagtgctgcaaaggcaaagaaa

SEQ ID NO: 412002 - DNA, 590 bp, Homo sapiens
cagatgaactaacagtgcttaaatactgaacagaaagaagaggtaactgtaagaatcgccctgggaatgcctaatccaagggagcagctcaaatgacaggcacacagatggacgcattgtgtgattaatggtgtctcccaggcctggtggagaggctgcaggaaatggtggcatatataagcgagtcctctttttggtttagtgctccttccacggtttgaagtagagaagaatcaggaaaaattccaacctcattgtttgctagaaaatatgaaggataaggccgccaggacttcactttgtgctactgcaagtgcatcaaaaccaatattgtgtctttggcattcgaatccatgaacttctggaagagaaaccaaaaagccatgtcaggtatggctggagcctgcattttcatttgggagcagaagcatgtcacatagtcttctaaaaagagaaattttgctttaaaaatgacacaacaaaataaaatgctgactgagtcatggtaaaaagcagtctttgaatttgaataaagtgtagcagtgctgcaaaggcaaagaaacacaccaagcggtctagttggcctcacg

SEQ ID NO: 412003 - DNA, 426 bp, Homo sapiens
caaattaaagatgttcctcaaatattttttcatagaaacaattttgctcctggtaatagaaatattacacagcgtttttgtttttaatctcactctccaacgagtattttcaaagtgcatctgccaaacttgaaaacagctagcatgcgtaactttcttttccccaaaagagagtagagtgtagttgaaaagttgtgactaaactacaaatattggcaaggtgatgttaattttgatgttatgttgaatgtcagtaggacagtcctttgataaagtcatcgcagtttgaattcagcttttttgttgttgttttttagctattatcttccccatctctttaacttttttttcttttatgaaactagggataaggccgccaggacttcactttgtgctactgcaagtgcatcaaaaccaatattgtgt

SEQ ID NO: 412004 - DNA, 575 bp, Homo sapiens
caggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccatttatcccagcactccacttgtggatgaaggagttgtatagaaaggagatgagaaaatggcaggagtggaagcagccaagaagagatcgatgactgaagatctccttcaccttcaggactgtctcaa

SEQ ID NO: 412005 - DNA, 501 bp, Homo sapiens
caggcatgagccaccgcgcctggcccaaacatcagttttgaaagtagggctacagtgatttatatgtattgtgggcacttattaatgtaacgataataaaacatgaatcgtataaagtcctttgagggaatctcctaatggctaggctctctgtcgtaagtcatattccagccccaggcttctgagctcttataacatacaactgagcattcttaagctcacaacctatttccagaaaagagacccacatctttctatgttttatactacctttgtttttacaccatatagtttttttctattagtttaaggtacctagtgttacaggtctagaaagtgcagagccatccctacctagaagagaatagatgggaagagaactgaaagaaagaattcctcaagcactgaagtcaggaaaatccccgtaggcactgtattagttgttccactcctgccattttctcatctcctttctatacactccttcatccacaagtggag

SEQ ID NO: 412006 - DNA, 490 bp, Homo sapiens
agtccagtccatgttgcttcctcaggagggaagtctctctattcacacctcacttcctgcaacaggagatgggtcagctcctgtgatggcagtcgttcggctccttgctgaaataaggacaagttgacttttttagacaatgaacactgatgactttgaaatattgtaaatcttttaacattaagagcatgcctggtcatggcccagcttttagaagacagcttattttgtgaagaattcatacaacaatgtccagcagctgttgaagttcttaacctagtagcccaggaatgtagtgctggtgagtacctgaacttgccttaccaccctgttttattgaattttctcagcacatttgcaatttgataatggtatgttaagtgtcttcatacacacacatcaaaacagccgagctgtaaggacaacacctgtcacaactcacgtgcatcacagacctagaaatgtaaataaaaagcttttaatctacacc

SEQ ID NO: 412007 - DNA, 1189 bp, Homo sapiens
agtccagtccatgttgcttcctcaggagggaagtctctctattcacacctcacttcctgcaacaggagatgggtcagctcctgtgatggcagtcgttcggctccttgctgaaataaggacaagttgacttttttagacaatgaacactgatgactttgaaatattgtaaatcttttaacattaagagcatgcctggtcatggcccagcttttagaagacagcttattttgtgaagaattcatacaacaatgtccagcagctgttgaagttcttaacctagtagcccaggaatgtagtgctggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcactacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccg

SEQ ID NO: 412008 - DNA, 968 bp, Homo sapiens
tgatgctgctccaaaagagtcagcacccacttgggagttgcgggagttgttttcacagattcaacatgtgccctctacaggagagcgacttgcagttgtggaggtacagtgtgaacggctgaggatgctctaccgggactgtgctcggcccccaccacctcctttgcaggctgaccgaagacagcccaaagagattacttggagcccctcgcgagtgtttccgcctgttcgagcctgcatgttctcatctcaccttacctcagtcaccttcctggctgaccccagcgctgggggaggcctgccccggggcacttttatctatgccacttcaccactgccagttcaggccccgtctttttactgggaaattgaaatcgtttcctatggagacaccgatgatgacaccggacccatagtttcctttggcttcactacagaagcagagaagcgagatggggcttggactaatccagtgggcacttgtcttttccataacaacggccgagccgtgcactataatggctccagtttgttacagtggaagagcgttcgcttagacgtgactctctcccccggtgacgtggcaggaattggctgggagagaactgaggggactccacctcctccgggacagccagccaagggccgggtgtacttcacatactgcgggcagcgcctctcaccatatcttgaagacgtctctggtggcatgtggccagtggttcacattcagaaaaagaacaccaaaacccgagctaactttggctcccggccgtttgcctacgcggaagggcaggcccaccgcaatgctgctgacctgtgcactgacctagcagaagagatcagcgctaactttgaggccctgcctttcgccatggcatctgacagtgacaatgatgctggcaccagtattgcatcagacccaggcactcatgggccaccatgccggattgctgccgtggccaccg

SEQ ID NO: 412009 - DNA, 424 bp, Homo sapiens
gtgtcagcagttactgtgtggcaaaagagaagttatttatatatttccaagacagtccagctcagaaaaaaaaagcaagatgagtggggtgtttgaaccttgttgtaaactggggggcaaaattgattgaaatgtttttcacagttgacttttttagacaatgaacactgatgactttgaaatattgtaaatcttttaacattaagagcatgcctggtcatggcccagcttttagaagacagcttattttgtgaagaattcatacaacaatgtccagcagctgttgaagttcttaacctagtagcccaggaatgtagtgctggtgagtacctgaacttgccttaccaccctgttttattgaattttctcagcacatttgcaatttgataatggtatgttaagtgtcttcatacacacacatcaa

SEQ ID NO: 412010 - DNA, 881 bp, Homo sapiens
tgacctcaaatgatccaccaaccttgacctcccaacgtgctcggattacgggcatgagccactgtgcccagccaccaaaagaatcttagaagaacaaaatttgaagactcacacgtcctgattttaaaacttactattaagctacaataatcaagacagtgtggtggtggcataagaatagaatttagatcagtggaacaggatgaggagtccagaaataagcccttacttttatagtcaatagattttgacaaggatgccaaaacaatctaatggaggaaagaatagtatttctaacaaataaagctggcacagctggatatccacttgtgaaggaatggtgttgcatccctacccacatcagaaacaaaaattaattcaaaatggatgaaattccaaaatgtaagatctcacactatataactcttagaagtaaacataggcataaatctacatgaccagggattagactgtgttttcttagattaataacaaaagcataagcaacaaaagaaagaatagataaattggacttagtcaaaactttttttgctggaaaggataatactaagaagtggaaagacatagaatgggaacaaatgtttggaaatcatatctgaacgggaatatataaaaaaatctcttcaactcaataatataaagataattaaaggatctgaatggatatatctccaaagaaggtatataaatggccaataagcatgtgaaaagatgctcaccatcattaatcagagaaatgtaaatcaaaaccaaaatgagataccacttcactctcaccaggatgactagccatcataggatagctaataacaagaattggcaagaatgtgaagaaattggaaccctcatgtactattagt

SEQ ID NO: 412011 - DNA, 1066 bp, Homo sapiens
agcggagtcgcgggccatctgggctctggaaggaacccttagaggagcgggaggacgccacaggtcctcggcggggctccgctcccgtgagccgcatgtggctggtgagctctgaaacgtggctggcccaagttgagatgtgcttgtcaaaatgttaccattattgctgggattctaagaaatctctacaaatgcctctgatgacatcagaaacaattggttctaatcctgtgaactctcttgtgaagaaagcatgagactccttcggtttagaagccatatctttcaggtcatccagaggtgcccaagccacaccaacagagaagatagtgattcctacaatgaaaacattttaaagtgaattgaaaatcaggtctagctaatatatggaattatgtctatatgttttccatacactgttacatagttgcagcgaaaactgcttactaatttctggacaattaaatcccctgaacaaattaagttttcacagtcattgtgacgagagtggcaaaagagtggtccaaaccagaaactctgctatatctgtaattcaccacagtaacagtaaatgcggatggtgaaaattttccgtatgaggttggcctgcatcaaacagtatactggagtcagagtcacaatccattaaagcaaggaagaatggcacaagagatgggataaaacaaggaccttacctgcatcatgtgcagcagctgcagggccttggacatcatcataggactgcccatctgtgacaattactaggaagttcttgttggggctctcccttatagggccaaacacatttctaacagtgaaggaaatggcatcaccagtagctgttccaccactcatatagcggatgtttctgatgacagctaggacattctctttggtgctatagtcagtgaaactgaactccgtgcgctgatcataagtaaactgtacagcagctatcttggcaccaatgtccgagatttcaaaagtcttggctatgttggaaacaaattcaagcatgaggcggaaattgctatctccaacactgctggagccatcaattagaaag

SEQ ID NO: 412012 - DNA, 781 bp, Homo sapiens
agcggagtcgcgggccatctgggctctggaaggaacccttagaggagcgggaggacgccacaggtcctcggcggggctccgctcccgtgagccgcatgtggctggtgagctctgaaacgtggctggcccaagttgagatgtgcttgtcaaaatgttaccattattgctgggattctaagaaatctctacaaatgcctctgatgacatcagaaacaattggttctaatcctgtgaactctcttgtgaagaaagcatgagactccttcggtttagaagccatatctttcaggtcatccagaggtgcccaagccacaccaacagagaagatagtgattcctacaatgaaaacattttaaagtgaattgaaaatcaggtctagctaatatatggaattatgtctatatgttttccatacactgttacatagttgcagcgaaaactgcttactaatttctggacaattaaatcccctgaacaaattaagttttcacagtcattgtgacgagagtggcaaaagagtggtccaaaccagaaactctgctatatctgtaattcaccacagtaacaggtatcaaagtctacttacctgtattggaattaccccctctgaaacctacttcctttatggcaaacaaaacatctttggctgatgtaaagtttttcaagtaaaattctattttgggatgttcactgagtggaagaaagaaaatgttattcagggagaattaaaaaggtaaaataagcaacattacatgccttaaaaaacagttttaaaaccaga

SEQ ID NO: 412013 - DNA, 558 bp, Homo sapiens
gctgcgggcggcctgacggtggcggcagatggcggggttgctgtcgctgctgtggcctttcttccagcgcttcaacttagctgagacaccagaaggcaactttcccgagcgacccatgttgactaagccgtggcgaggaatgagcttaaatgaccggcttccagggacgtagaaacacgctcagaacccacgtggataccctgtagccttcacttcctcttcttctggcgtcacttccggattcgtgtgcattactatgaacctgagtcttgaggcatcatctgggctcatgccctctctgaaacataaatcctgtactccacagacaccagctgagccgggagatctgaacatcaggcaatgagtttgcaagatggtttaacaactatgaacatgtggtgtcctcacaggaatcctgtgggctgaacagcagccgcccctccttccacccagcacaaaacttggtttgccccgctcactctaaatctgggccttcaatgaatgttcagtggagttcttctgtggaaaaaaataaatgggaaaggaaggctggagagg

SEQ ID NO: 412014 - DNA, 544 bp, Homo sapiens
gagaaaattcatacctgaatactgtagacggctcccaaatgttagctcagaatttcagagaaagagaggaaccaactctcactctcctttttctgccacaaaggcagtgcatagggacaggaggcagataaatgctaggtagaaaagagcgggtccctggtgaaaccccaccctcaagccaaaaagcctgaaaccatggcccaaagtgagaacttctatccatgtttttccagttgaatgttgccttttcctaagccacccatggctctgccctgcctcatcctgtgcctagaaagaccccagactcatctggcagagaggagaagcagctggatgaggggacgaccatggctggatgtcagagagaagcagcttgtcttcagagggacagcttaaggcgtaacttctgagacgaatctggctggagatagctggacttcaagggaagactacataccggcctgtcccacccccctcttttcagctcaccttccctctgaaatccactttgatcagcaataaatcccaggcatttgtcctttaa

SEQ ID NO: 412015 - DNA, 373 bp, Homo sapiens
agggaacggaagtctctggctggaaaggggaaataagtgactatatctgggctgtagagtggttgaatgttgccttttcctaagccacccatggctctgccctgcctcatcctgtgcctagaaagaccccagactcatctggcagagaggagaagcagctggatgaggggacgaccatggctggatgtcagagagaagcagcttgtcttcagagggacagcttaaggcgtaacttctgagacgaatctggctggagatagctggacttcaagggaagactacataccggcctgtcccacccccctcttttcagctcaccttccctctgaaatccactttgatcagcaataaatcccaggcatttgtcctttaa

SEQ ID NO: 412016 - DNA, 446 bp, Homo sapiens
gatcatgtcatgtacactcagcttacacatctgacaccctcccaccttccttaacgtttttagaaaacagggagcacttcctcatgaacctggtgccatccagccctggggtgcacgggttaacgcccacttccacgccccccactgatcttgaggcccccccgcccccaaccctggcctccgttgcccacaggtgcctgtttccactcaacccaaatttaagccatcttcttgctttcagagtgtggtctttaccaacagaggaaccgggtaatcaccgcacttctcatgtattcagaagatatttctcatccttttcaggctggtagagcagatcacccccaaagcaagaagttccagatgaaatatgcataagaagcagcctcaaaactaacaaaaaagattcgcacattcctcagttagaggaggagcagagatgaagaaaa

SEQ ID NO: 412017 - DNA, 238 bp, Homo sapiens
atgcagtggggcccctggggtgccctcggcagcttcggtccagcctgcatctgcccctcggccttccgacgtgggcggtgggccccagccccacagaccagcccagcattcaggctggtagagcagatcacccccaaagcaagaagttccagatgaaatatgcataagaagcagcctcaaaactaacaaaaaagattcgcacattcctcagttagaggaggagcagagatgaagaaaa

SEQ ID NO: 412018 - DNA, 521 bp, Homo sapiens
ctaaaccagaaatgttttcttgtactgatgctatcagaaggaagttttttctgcttaaaaatatagttatatttctagctgtctttaaaatacggtttcaaactagatattgggcaggtgcggtggctcacgcctgtaataccaacacttttgggaggccgaggcgggcagatcgtctgaggtgaggagttcaagaccagcctggccaacatggcgaaatcccgtctctactaaaaatacaaaaactagccaggcatggtgttgggcacctgtaattccagctactcgggaggctgagtcaggagaatcacttgaacctgggaggcagaggttgcagtgagctgagatcacgaaacacagtctcaaaaaacaaaaactagtttttaatttccccccccacccccgactttttgtagcatatgttctattttatgtctctggtactcaggttatttactaggtatattaggctgcagactattaagtgctgcaaacaagaacccctaaaaaacatgtacttt

SEQ ID NO: 412019 - DNA, 518 bp, Homo sapiens
gggagcggtatttaagaggagcctctgcccgcccttccacccgcctccgggacgatcttcggatttgcgctgtgctggaccttgttagacgatggaacgcgaccggccacgtgcaaactctctgagtaggtcccggggatggtgccagaggagccggagtcccagcaggaccgattggtagttaaatgccaggcgctgatatccgaaggcttgagttcttcaccaccttctagctgagtaacctggggcaaattcctccatctctctcttcatcccacctgtaaaatgggactatcttctcccacttctctgtgctaagagaactaaatgaaatggagaggatatgtaaaactcctaaagtggcgtctggcacccagtaaaccctccaaaaatattcagtgcattttcagagtccttagaagatagtttattggacaaaatatccaagtatgaacagacagatgagaaaaataacaagaaaaagaggggaaaacacattaataaaatttaaaaaataa

SEQ ID NO: 412020 - DNA, 422 bp, Homo sapiens
ctgctctagtcaggttctattgtgctctactcttccccaaaagtatagtgaaggctctcttgggcctgaaatccaccaactccgtacacactaaattgttgtatatgataactcttgttgatatggaattatctttgggttaggtctagggagtggtgagctctcactggagactcaggaatattgttcctgatgtgggcttaatgaactttacctcattcatgtttatattcagtccttgttttagttagagaatgagaaggtttgtaaaatcatttgctctagataactgcctagagcaaaacctaagccttctggcttcccagaggccagataaattgatttttggctttggatttggtaggatcttgggttagagacaaaaggaaaagtactgaagcagttagggacagactaaattt

SEQ ID NO: 412021 - DNA, 417 bp, Homo sapiens
gctctgcagcatagtttgaagttggggattgtgatgcctctggctttgtcctttttgcttaggactgccttgactattcgagctctttttttagttccatatgaattttagaatagttttttctaattctgtgaaaaataacatggctagttttatagaaatagcattaaatctgtagattgctttgggcaatatgaccacttcaacaatattgcttctttaaatctatgcatatgggatattttttcattttttcatttgtgatttctttttatttttttattatactttaagttttagggtacatgtgcacattgtgcaggttagttacatatgtatacatgtgccatgctggtgcactgcacccactaactcgtcatctagcattaggtatatctcccaatgctatccctcccc

SEQ ID NO: 412022 - DNA, 636 bp, Homo sapiens
cggccgcgctgggccaccgcaccgccgcgctgcaccgccgcctcgacgccctgcaagccgccgctgcgcgcctggaccaccgccgagtgaaaatccaagccgtctttttggataatgcggtgcctgactgtcagcgttgtctaagagggaaacagcaggctcgtggagaggacctgggccaacgcaaaaaacccagcgttttgtttgctgggctgttctttgtctctagttgattttgaaaagaagatgaaaaaggaaggctcttcaggttccttcagactccagccgaatacaggttctctctcacgtgctgtaagttggataaatttctcctccttgtccaggcagacaaagaggctgtttcgcagtgatggagagctctcggtttgtgggcagcaggtggaagtggatgacgaaaactggatatacagagcccagcccagaaaaggtgactcgatttttaaaaaatttaaacatttgaaaaagtttgttatgtagaattctttgtttctatcactcccccttcatgatttttgcccccattaggagtttcttttgaaatgtttgtttttgtattggaattcggcgtcatttgtttacatgtctaaaataaaaatgctcttcctcagcttgagc

SEQ ID NO: 412023 - DNA, 297 bp, Homo sapiens
cggccgcgctgggccaccgcaccgccgcgctgcaccgccgcctcgacgccctgcaagccgccgctgcgcgcctggaccaccgccgagtgaaaatccgtgagtggccggcgggccgggggaggggaaccggcgggggaggcacccggagagctgctcccgcccgccccctggcggccctgggtcgggggtctccagtggggactgccggaccccagcgggaggctgggcaggtggcaggggcgcagagcgctctgtgactttcggactcctggagggtcttggctacctcgagagagt

SEQ ID NO: 412024 - DNA, 780 bp, Homo sapiens
ttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcacta

SEQ ID NO: 412025 - DNA, 628 bp, Homo sapiens
cggccgcgctgggccaccgcaccgccgcgctgcaccgccgcctcgacgccctgcaagccgccgctgcgcgcctggaccaccgccgagtgaaaatcccggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcacta

SEQ ID NO: 412026 - DNA, 841 bp, Homo sapiens
ttaatggtttgtaactgcctgacaataaactcaacctcagttacatcagcctgggcagatgtctaaggatatgagaccgggggaagaaaaagttagaatctgtagcagaaggacgaagcttgccacctgcctactgggctgagcttttaatgtgatttacatttctaagctctatgtaggtgccctggaaatggtggtcttcattaatgcaaagattaagtctttaattaaactttttaagaagaaaacggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaaggtttgattgggcgtggtggctcacacctgtaatcccagcactttgggaggccacggtggccagatcacttgaactcaggaattcaagaccagcctgggcaatgtagcaagaccttgtctctacagaaaatagaacaaaaactagctgggtgtggtagcgcacctgtagtgccacctactcgggaggctaaggtgggaggattgcttaagcccgggaagtcaaggctacagtgagacgtgtttgcaccactgcactccagcctgggcaactgggtgagaccctttctcaaaaaataaaaataaaaattcaggt

SEQ ID NO: 412027 - DNA, 584 bp, Homo sapiens
cacagcagacagacgtcgacatcgtgacagtgctcgatctacaacgtcgtctcggtttccaacctagatgaggaaagccgatggacagtccactacactgccccgtggcaccagcaggagaatgtgttccttcccaccacaagacccccctgtgttgaggacctgcaccgccaagccaagctcaacctcaaatcagtactgagggaatgcgataagttgcggcatgatggctaccgcagttctcagtactactctcagggacccacctttgcggccaacgccagcccattctgtgatgattaccaagatgaagatgaagaaacagatcaaaagtgttctctgtcttcatcagaagaagaaagatttatttccatcaggagacctaaaacaccagcctcaagtgacttctccgaccttaatactcagacgaactggaccaagtcgcttccactgccaacaccagaagagaagatgcgacagcaagcccaaacagtccaggctgacgtggtgcctattaacataactgcatcaggcactggccaagatgatgctgatggccactcagtgtacacccctgatcacta

SEQ ID NO: 412028 - DNA, 442 bp, Homo sapiens
tgcaatacaggtagtagcgagtcacctctgtgctgatctggccctccgtgacgttcaggatgaaggtgtcaggagccacacagaagtcactggtggcctgagtgagggagagagggacggggtggaggaaaatcaggtatcaggacagcggggccctgggaggagccgggagcccatcaccccagccccttgagctccctcccaggtggcaaaggacagtctggagccagcctcctgggttcaaacctggctctgccccttcctagctctgttgccttggacaagttacttattcttcctgtgccccggttgcctcatctgtgacatggagatgataatgctattcacccaatgcaagtaaagtgctcagaaaagtgactggggcagagcgcatgctgttactcttattcccgaatgcctcttctgggacagacctttgggg

SEQ ID NO: 412029 - DNA, 562 bp, Homo sapiens
agaactgctgttgagactgattaggataactatcatttgttttatacctactatgtgttatgattcccactttcttttttctcgtagagtttaaaactctgtaaaataaggattatcatctctaattttagatgagaaaagcaaggatcatagaagttatgtatgttacccaagtttatataactactagtaaaaaagttgaacacaggcttatcatattttgtgatttctgtcctttcctgtaagtgtacagcagctaggagtcaacctgcagtgttctctgtatagaaccatctcagaatataagcttataagtggtacttaaaatttaccaatggaatgtttttccccatcagaaacccacaccaataagtagcttcatggcagttaacaaaagggaaaaaaaaatcaccacaaaaattagactgaatgctgtataaagttggagccatatatgtaattcctgataaatagtgatagagtatttatggaatctaatgagttgttttaatgcaaatttgtgttctggaaatggtaaatacatatgatttgtgagtgttga

SEQ ID NO: 412030 - DNA, 489 bp, Homo sapiens
ggaagcagctccagaagtctctttatactgtagccaatgaaggatgagagaatcataccccatagtttgaccaggaggtgtcgcatgaaaaacaaaccagcttgctaagggccaagggacatatttaactgtaaagaatcaagaatgggggacagaacgggatttgccccttcttgcctccttggagagaggaccagggacactgccttctcagggagcagccaggcacgtgtcctgtcctctcagacatacccgtggcagggagcagctgatctgtccacatgctgtgacatttctatcttctcagagccaggtgccggtctggccagcaccactgaccacttgttacagaaaatgtgtctgaggaatgtaaagaggatcaaaatgcttctgcctccaggatgatcttctgcctctgctgttgctggagaggaggaagccaacatgcacttttctctttttgcaccctttcattaattttctgcagca

SEQ ID NO: 412031 - DNA, 466 bp, Homo sapiens
cactcccataactctcttaactgagaaaagagctggatacaaatggaacagcatagtgttcaaaccagacactgaaatgttttctcagaatacatttctgggatatttagcaaggcaggaaaaactcatccaagagactgttttcatttcaggcttctaaatgcctaacccttaaggaaaataaggcaagaagagcacagctcctaccagtgtgagaggtgcctctaggagaatgcagtacagatctgataccgtgtggtgggagaaatctggtcttttaggaaaacctctggccctgtactaacactttggcacctttatgctgaattccttttttaaaatgtaagtaaaaacagatgataaacttcatctaattcatctaagaggatttagatttaaaaatgtaactgctgcactgctgcacaattcttttaaaatttaaatggaataaaaattcaattaaaga

SEQ ID NO: 412032 - DNA, 304 bp, Homo sapiens
ccagctcttgaaagtcatttctgtagttaatcatataagaacgttgactccttagaatggttgaaatggtagtattccactcagaaaagcctaatctaatcctggagcaccaaggttacgaacctgaggccaaggttttaaattccaactcactcaggacgagtactttgtagagacttcatccctgacctaggtgggccatctccaaacagaacctttggacagttccgtggtcagcttttatcttgcattttagtaaaatagaaacagttgtcttatgtgtgtagcatttaaacattctaga

SEQ ID NO: 412033 - DNA, 318 bp, Homo sapiens
tcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagcc

SEQ ID NO: 412034 - DNA, 313 bp, Homo sapiens
  misc_feature (19)..(19): n is a, c, g, or t
  misc_feature (37)..(38): n is a, c, g, or t
  misc_feature (75)..(75): n is a, c, g, or t
gggggtgtaaggggggggnaggactttagtggtgtannggtaatggctggccaaatggtatttctagttctaganccttgaggaatcgccacactgtctcccacaatggttgaactagtttacagtcccaccaacagtgtaaggggggttcctatttctccacatcaccaccaacaccactagtggtgttggtggggatggctgctctaaggtactttgtgaaggtatggttggtttgatttcaggaccctcagagaccctttggtattcctctgatgatgtcacattccctcatcttcagccacctattact

SEQ ID NO: 412035 - DNA, 951 bp, Homo sapiens
ggtcaatcagctcaaaacctccatgcagtcagttttacaggagtggaagatttatgatcaactctatgatgaagtgaatatgatgacaatccgattctggtactgcatggaacacagcaagcctgtggtgttatcattggagaccttgagatgccaggtggagaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccac

SEQ ID NO: 412036 - DNA, 874 bp, Homo sapiens
gggagagcgctgaacccagctgagctctcaaattaggtcaaagtttcccaaggagggctgatgccttggctagaaaccaggtggggaaccttcagtctctgcaagatgaagctgagagcagtgaagggagttgggagaaactccaggaggttatcggcaaactcaaaggtctctgcccctctgttgctgaaataatcgaagagaaatgccaaaatactcataaaaggtggactcaggtgaaccaagccattgcagaccagttgcagaaggcccagagtctgctccagctctggaaggcctatagcaatgctcatggtgaagctgccgcaaggctgaagcagcaggaagcaaagtttcaacagctcgcaaacatcagcatgtctggaaacaacctggcagagatcctgcccccagccctgcaggacataaaggagctgcagcatgatgtgcagaaaacaaaagaagcctttctccaaaattccagtgtcctggatcgactcccacaacccgcagagtccagcacccacatgctcctcccgggccccctgcactctctccagagggctgcttatttggaaaagatgctgcttgtgaaagcaaatgaatttgagtttgttctctcacagtttaaggattttggagtccggctggaatctttaaaaggtcttattatgcatgaagaagagaatttggatagacttcaccaacaggaaaaagaaaatcctgactcattcctgaatcatgtgctggcactgacagcccaatcacctgatattgaacatttgaatgaagtgagcctcaagctcccacttagtgacgtagctgtgaagacgttacaaaatatgaaccggcaatggattcgggccacggccac

SEQ ID NO: 412037 - DNA, 165 bp, Homo sapiens
ggacgggagtgacgcagcggcaagacgaagaacgcctggggccagcagtagctggagaggcaggggcgagggcgatcctcccctaggacctagggggagagcgtggccctgctgccacctggattttggatttctgttttgagccatcacgtttgtggcaactca

SEQ ID NO: 412038 - DNA, 263 bp, Homo sapiens
cttttgttaaaaagacatctcaaagtaggcagagaaagaacttataattccaagttttctaaaacaaatgctctaagaaacaagaaaacaagaagtcagggcctagagtcagtaagaagctggtctaaaattcagtcatgctgaggagaacgtcaatgccatctcagtcataaagttatggtagatgttgatgtttaaaaagctacacatcagcagatcagttttaaacaaatatgaatgttagatgtttacagccctaactt

SEQ ID NO: 412039 - DNA, 362 bp, Homo sapiens
gaaaactggctttgctgtgttatggctagaacgaagataacgtgaaagagaaaggcaggaaatgaggctgaagagaaagtagggaaggtccaaggactttgtgttgacaggttaaggtttatctcgaaagctacatggagccatttaacggatattaaatcgtagctttaaagtatacattttcatccagaaacttggcttctgaaagaaaggcaagaaagtaatagcaaaaaaaaaaaaaaaaaaaaaaagtcacagcacagtagttagaaaatgacatcagatgagagaaatgttatttatttaaagatcagatagatttgaataatttataaaagaactagtactgagaatgtgaagat

SEQ ID NO: 412040 - DNA, 106 bp, Homo sapiens
caccaagacagaaaaccagaacattccatgacatgcaatgccctacgaagaggttttttaaaacatattcgcactgtctagccgtggcaaggggttagctgtcaaa

SEQ ID NO: 412041 - DNA, 431 bp, Homo sapiens
aaaaaaacaaaaaaaaataaaaaaaaaaagttcacaaactatcaacattttaacaatctaatagttgattgttgtttcccaaattggtgattttgaatgattattttatgtagaatggaactgtgtctttttcttcattcatgcaacaaacatttcctgatggataccaagcaacggtgacaggtaagcatgccatcctagatcagtgttatataactcccaagcttcagtgaaggcctcatttttgttattacaaactgcctctctgggacctcatgaaggtactattcctgtttcgggaataggtctatccatccttgtctttttgtttcctgtcttgattctacaatctcccctttggccattaccatctcaaaatcctgcttcccaaggtaatccgtctagcttttctaatcttctggcttcccatt

SEQ ID NO: 412042 - DNA, 659 bp, Homo sapiens
ctcagtttcttcatctgtaaaatgagaaattacaactatgtttgctacattccccatctggcgctacaatggtgtgaccatgattttatcccttgcctccgaccaacaataacatctgtagccagctagaatttcttcactgcatccaagagggcaaagcccatttttcaaaccctttccttagagaaataaaatggataaaagatgaattgggaaggggtggtagccctgcatttaagtcttcttagcactcccatgaccgtgtaatgatgacaaatggccgtttcatcagaggaagctgtcagtgatagccattgcgtttctaatgctaaaatgattttcccacaaaaaaaatcacttttctaaaatgaggcatcagaaaacagacagagaaaggaaactaaaggaaaggaaggaaaagagagacagagaaaaggggagaaacacttctgtatatctgacatattctttgttcaacgaacactatcagtaatgatggaggtgggaacttgaatagaagataaaagagctgagatatcaaagacaaagtaaacataattcatctattatgacattgcctaggttagcacacatggctggaaagagtccaacagcatatgagtgattctggaataaaagagaagttgggcatcatgtaa

SEQ ID NO: 412043 - DNA, 634 bp, Homo sapiens
atcccatttctaccaaaaatacaaaaaattagctgggcgtggtggtgggcgcctgtagtacaaggctgaggcaggagaatcacttgaatgcaggaggtggaggttacagtgagctgagattgtgcccattgcactgcagcttggacaacaagagcaaaactctgtctccaaaaaaaaaaaaaaaccagaaatagatggcctcagagaaaaggggttgggttaaagacatcacgtgacgcataaggcataatgtctttagcttttactttgaatgagatgggaagctattagagggctttgtgaagagaatgggagggtcttactcatattttaacaagatcactcttactgagaaagataatgggtggctgttcagagaagcagtgatttttggtgggaccagagaaatggcaatgggagtgatgaaaagcagatggatcttaaaggtgttgctgagaaatttgcttatgttgtgaggcttgagagaggaatcagatgtggccagcgtttttgtctggacaactggaattatggaatttacagtgacagtgattgggaggagctaaggtgaggagcagatatcataaatcagttgtggacatgttaaagttgatccgtttggagagatattaag

SEQ ID NO: 412044 - DNA, 649 bp, Homo sapiens
aaaatggcatttaaataaatatttattgagcatctaaaatctatataacattgatccagtagtagtaataatatggtggtatggtggttgtcatcatcatagcagctagcattcaaagagtatgtagcaatcatggtaataagcaggacttaacattcattatcacattcaatcactacaattctataagctgggaattatgtcccttttaaagattagaaaactgagacatggctttctaatgacttgcccaaggtcacacagctaagaagtggtgcagccaggatttgaccctatgtaatctgctgaagcaggtaattaaagaaagggcagccgggtgctggtggctcacgctgtaatctcaacactttgggaggctgaagcaggtgtgagccaccatgcccagccaagaagtcagatttaaaggtcttagtaaaaccagtcaaagaattagtcttgctagtttctggaaaagagctctataaagacaggaagtacaagttagagagaagaatttatgatttcagagataaaactattccttacaacaagacaccatgatacagccacagagtaagtggcagacataaaatactgatggtctctagaaattaactcaagcaaataggaggtcaagagtgtacagcac

SEQ ID NO: 412045 - DNA, 540 bp, Homo sapiens
aaaatggcatttaaataaatatttattgagcatctaaaatctatataacattgatccagtagtagtaataatatggtggtatggtggttgtcatcatcatagcagctagcattcaaagagtatgtagcaatcatggtaataagcaggacttaacattcattatcacattcaatcactacaattctataagctgggaattatgtcccttttaaagattagaaaactgagacatggctttctaatgacttgcccaaggtcacacagctaagaagtggtgcagccaggatttgaccctatgtaatctgctgaagcaggtaattaaagaaagggcagccgggtgctggtggctcacgctgtaatctcaacactttgggaggctgaagcaggtggatcacctgaggtcaggagttcaagaccagcctgaacaacatggagaaaccccatctctactaaaaatataaaaatcagctgggcgtggtggcacacgcctgtaatcccagccactcaggagactgaggcaggagaattgcttgaacccgg

SEQ ID NO: 412046 - DNA, 692 bp, Homo sapiens
gcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctggtggagtacgacaaggagttctcccctcgtcagcgacaccacaaagagttcaagttcaacttatcccagattcctgagggtgaggtggtgacggctgcagaattccgcatctacaaggactgtgttatggg

SEQ ID NO: 412047 - DNA, 581 bp, Homo sapiens
gatagagccttttttggagagagggtgtgggcagacatggttttcttcagtgtcgaaattggtatggagacgtggatggagatttgagtcttaggaatttgggaagagctcaagtgattcagaatgaaaagaccttggcacagacctgttaaggaagctccatataaggtgaagaaaacaacatgctcagccatgtccttgccttctgcacacggtagtgcattcactgcctgagaattcaaggctaaaacaaaaagaggagcttttgttccaacagataagtacttacctttttcaaaaaatgcataagctgtcctgggtgtttagcagttattcgcacagctttccaaagactcacagcatttaaaagctaactctacagagattcaacagcttcttccagatcccaccacagtggaaaagaactccggtgtcctggctccctgtccagctcttctctctccccttccagctgccagttcagctttaagaagttcattctccacattcagatgcaggcaaatgcgtttgacttgagcatattgatttcaggcaggtgagagtggatgtagcgattcagc

SEQ ID NO: 412048 - DNA, 198 bp, Homo sapiens
ccatgtgttaagaagaaaccagccaagactcagatcaggattggggagtccacccctcgtttcccttcagagcattatttccttgtttgctaagaggggcaggaactggaaaactcaggctagcccatctgagaagactttcctggagatgagctggaggagggaggagtaaggccttggaaggaaactccaggacag

SEQ ID NO: 412049 - DNA, 393 bp, Homo sapiens
cagtaaatttgagccttgggtcttcatgatggtaccacagtttatatagaaaactatgaatatacaagactccaggggaaaaaaagtcggaatacataatatttaacattgtgtatgactaaaaatcttttgaggggagcgggaaaaggacagccaactgaatctttaagaatacagaaactatgaaaaattcctgggtcaaagggtgctccaagtggaaccacactttgtggggggaaaaaacccacaagaaacttcaggtattttttttaaagaaaagaaaacagtactgaataattgcagtcccttccaaaaaggaaatcttaagttaaggggaaaagatttgaatagcgtaaacgagtctggctcagaaagaaaactgaacaacatatc

SEQ ID NO: 412050 - DNA, 438 bp, Homo sapiens
aaatattagaaatttgccagcattgaattctgaaatttcagctcctttccctctcgcttttgtctttataagtagtttttaaagctatcgtggatatcgtatttgtgggctgaagattatgggaattctcttttgattatataacatgttttatactaatagtttgtaggaaattctcctctgttcccaagtcttaacattttattttatttgtttacttacttttgtagagacgaagtctcattatgtttcccaggctggtcttgactcctggtctcaagtgatcctcctgcctcagcctcccaaaatgctgggattataggtgtgagccaccatgtccagctaagccttacaatttaatttcaggtctaccattagaatgcttgctttcttttttcttttttcttttttttttttgagatggagtctcactcagcc

SEQ ID NO: 412051 - DNA, 794 bp, Homo sapiens
tgatttttaaatctgtcttgccttctgtgtgcttgttcatttgtgaaacatgtactggaaaacctcctttattttaggcatgatcctaggctctgtagatacagaatcaggaactcattgtctgaggaaggggacagataagaaagtgactatatgtaataaagtgaaataaccatggtaataaatacaagccaggcctcctaaagacctttggtttcttaacagataacttgcttttgaatttggaataatagagtttaaaagtaaaaactaatatttcacctaatattttcatcattgtccaagtcacaaaatttaaaggtaaaagagatcttagaaagtgcctcttctaaccacctttccttacaaataagaaaataagagttggtccaattcccacagccagttagtaaactgagagaacactcttgctgcctataccaagtcacagtcctcaaaggttggattggatactcactgatggccaattgtctgttcatatttgcttatttaccggatacctcctatgtgttcagcattatctttgtgctagttatatgaaaaaaataaaatttattcctgcacacaaggaattcacaggctagttgaggagatagataagggaagagacaattataatagactactattttctccaataatattccttaggaatcattagttgcaagatatagaaacctattcaagctagcttgaattaggagagattatttatttactgtaaggatatgaggaaattatatccttatttattacatccttatttattgtaa

SEQ ID NO: 412052 - DNA, 2773 bp, Homo sapiens
  misc_feature (2564)..(2564): n is a, c, g, or t
acgaaacgttcgtgagttccctgctctgaggaaacaagcttaaaaactcagaatctaaggtgtgagtctccgcaaacctgcttgttgggcagcgtcccccgcccgggctagccctgcacgccccaccccggagccacgcttctccagccgggacccctgcctccttccaggctattctcggaaccgcagccagagggaatttttttttcctttcctgaaacgtagagcagatctggttactcttctgcacaacgccctaaaatctagggcccttcccatccctcagaatttacatctaattctcagctcccctccggcttgctgtagccatcctggcttttgtttagcacagcacttactgttagtgacattatattgtatattattaacatatttgtgttttacatccctcactagacccccaggaaagaggctttgatgtgttgcctgctgcaaggctggctgcataatttgtggagctcagagaaaagtgcggagcttccttgttcaaaaaacagaaagaaagtgcctctgaggtcataaaatataaaactttctctttcctctcagtttctctcttttcatagtgtttttatgtgttatttaatatcattccaagaaaaatttagatttaaattgttagcatgaagttcaccatccatctttacgttgtgcaatgccagttttaaatactaatataagtgcactgatctcatatgtggaatcacagaaattatgcaatttgtacttcatagcttatacatgcatatagattttgtttttaccagaaccacgctggtaaaaacagatgctgcacaaagtgaacttgcccgttttcatcgcactttacgtgcacgaattctacctctactctcgacctgggactcaccgatgcgtaaggaaggactgaaaagcaaaagaactatggactggccttttggcatgatcaggtgtctaatataaagaagtgcatgaataagaaaatatatgatatgagtgatggttaatactgactgtcaacttgattggattgaaggatgcaaagtattgatcctgggtgtgtctgtgagggtgttgccaaaggagattaacatttgagtcagtgggctgggaaagttcgacccactgttaatctagatggacaccatctaatcagatgccagtgcagctagaaatgtaaagcagacagaaaaatgcgaaaagagagactggcctagcctgccagcctacatctttctcccacgctggatgcttcctgccctcgaacatcagactccaagttcttcagtttgggacttggactggctctccttgttcctcagcttgaagactgcccattgtgggacttgtgatcatgtgctcaggaagtatgtgtggacttttgtcatgggttgaatagtgtccctcgcaaagttcacgtccacatggaacccgtgaatgtgaccgctgtggtttgaatgcttctgtcaaaacttaatccccaatgcaacaatacaaagaaatagggtctttaggaggtgagtggaagtcgacggccttataaaaggcttgactgagggagctcacccctttttgcccctcctgccccttccaccatgtgaggacgccgaggctgcattatctgtgaggaatggactctccccagacgctggacctgccagcatcttcaccttggactttccagcaaagactagaagaaataagtttctgttttttctacatgacccagtttcagatattttttagagcagcacaaccggactaacacagtgaccttagttggaaatcgggtcattgcagatatgatcaggttaaagacacacagggaggggccaccgtgcgaagatgggggcggagactgaagtgacctggccgccagccaggcaacaccaaggactgccaaacgactggactgtgtcgcttaagaaattaattctgtggaaatttcacatccatcggcaagttctccatgagaattttgtatcgtgttttccattctgatgaaaacttaaaaaatgatcacaggccttcttggaattatcaggacaacgacttttgtcatgttatttcaaggccacacttaaacgtttgcctccacttcagtgccctgtggtttcaaaaaatgtatcaggtcctaacagcagcatccttccctgtttcacattgtgtcaagttgaattctttaaccagctgtgagggcaaaatttctcgtagatcattggtagagcatttttatagacttcactttcttaagttacttagtaagcaaagactttgattcgacagaatttaaaagacctagtattgcaaactgatgctttctttaattgtcctggattaataggagcagaagcatacttaatgttaaagagatactgctgcatcaacaaggccaaatgaagtcatgttttacctaagcaataaaggtagcagaggttagacagaaaagcgtgctgggtgaactgagacctcctcccacaccggctgtggagccaagaggacctgggcctctgctgtcagcccaacacgctcccctcccagggatgtgtccgccagatcccaanatcatatacttcctcagaagcaattgcaacagtcagttctcagtcagtgtagcgggagatggcccacaaagaagttctcattcaatgacatatttttatttttcatgattgcattttggaatatattttaaaatgattggcctgtcaacataatggattggcagttaaaaataaccaggagaatatgtaaaaaataaaaagggtaaatt

SEQ ID NO: 412053 - DNA, 1002 bp, Homo sapiens
agatgggatttcacagtgttggccaggctggtctcaaactcctggcctcaagtgatgggcctgacttggcctccgaaagtgctgggattacaggcatgagccactgtacccagccaacattttaaaaattaaaacgtaaaatatgcaatttgattggtttttccatctgtatgcatgcatgaaactatcatcatcaatgagcatttctaccacccctgaaagttttcttgtgcctctctgcaatccatgccttcctcccaccctttccccatccaaaccactgatctgaaagcacttttaatgctgttcaagtggtatagagaggtgagcacagaatgcaggtgctgagggagagcttagatgagctcctaatccagctgggatgggagtcagggaggcttcctggaagaggtgagattggaactggggtcagaaggacaatcagtgagaccaggatggcacacagataccataggtcatttaataggtctgcagtgtaagctttggctcaaatcctgcctcagttgcctctttaatcccatgaccttgggaaagttcctgaaacttactgtttgattcctcctctaaaatgggatgaatactatgtctcttttaaatagtttttgtagattaaaaaaataggggctgtgggttgtgcctgcttagtggctggcacagggcaggtccacaatgagtggcagctttcatttgcaccattccagcattcaccaaatctgtctcccaccgcccagtgcaatctgtgcccttttgttatgacccatgtttatgcctccataaaaatgtttcttccatttgaagtccttatcctcgaatgcttggagccttggaggaagtctgcttgctctgggaagccgtcccttatcctccaggtgctattaattcccttctgcatttccacagtccctctgccaggtttgagctgtcacttcctttgttttgtgctcacttggtgatttagatgtccatcttccccctgtggga

SEQ ID NO: 412054 - DNA, 608 bp, Homo sapiens
ttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttga

SEQ ID NO: 412055 - DNA, 504 bp, Homo sapiens
aaaatacttaaacacattgcgtttaaataataaacagtaaacaaatggtaatatttgtccttaggtattattgcactaataagataacccattaggcaaattaaggttacattttacttttgaagagactcatcagtgacaaggctgcagtggctcagcttcagtgggggtgtcacactggggagtgtctttgagggaaaggcttgtgccccgcatggtggacacccaggccgttgtgattttttttttgaggtttcccaagtattgcaaatcccactttgcaaatgtaattgcagcttctttgcagctagttttataaggcaaggtcaggcttctgtctaggattgctaggattctccaagcttgttgagttcacctgaatcatgaggacccatagtgggagtggggagtggtttaagagcaccaggtgcagaattgcccgaagctggccaggtgcgtcagcccagcgtctgtaggcaggggaccgggggcacacgtggtccc

SEQ ID NO: 412056 - DNA, 575 bp, Homo sapiens
ctctcacacagtgtcgcctaggctggagtacagtggcgtggtctcgactcactgcaacctctgcctcccgggttcaagcaattctcatgcctcagccccccccaagaagctgggattccaggcgtgagccactgcacctggccactcgcagtagatcttgattatgatctgctaaaggcacgtccttgactgctgaccttacaggccacgccactggcagctgcccagagcaggagctgtttgtgtcaggtgcttgtcacagctctggagcatgagacctgagtgtgaagaggggagggggtctggggtgggacagaagctgtgtagggcagtacctgccctggggctccacctgcaaggtcaacaggacacagtccttacatggtggggttgagctggtttcagtcccaactcaggagctcctcagagagtcagttccacccacgtaggttggagctagctcctcaatgccactgtgaaggaaaacgaaggacacagcctcaccaagcaccaccccagccaggtgtgacgccactgtgaatgtgtctagtcctcaggaccacgagaggctgtgt

SEQ ID NO: 412057 - DNA, 581 bp, Homo sapiens
gcattggtctacatgtctgtttctatgccagtatcacactgttttaattactgtgcgcttcgaactaagttttgaaattaatgacttttgcatattgtctcactccaaaaaaaaaaacaaccttaaaaatgttcttttttttgttttgttttgttttttgataagaaaattgaggctcagaagaataagtaacttgccaaggtcaaaactagaaaatggtaaattctggaatctagtccagggatatctagttccaaattttatgctttttatattaactatatcatcttgtgtaaacttgaggatgatacttagcttctgcgtcttcagtaaactcatctgtacaatggcctgttaaacctagctatttgaaaacatcagctaaaactaagtgatttttttgatattcatttaggtcttttatttcttgatatgcttgaaatctaattgtcttttaaatgcactaatagttctgaaagttaagtttatttttaaattttttattatttttcattttttaattaacaaatgaaaattgtatatatttatgaaatacaacatgatgttttgaaatatgtatg

SEQ ID NO: 412058 - DNA, 475 bp, Homo sapiens
aactttcattcagtttcgttgaaactgttcgtttcttaccagatttaacctttacatatttcgtttgaaaagctttgtgagagatctgaccctcccttcattttgtattctgttttttttcctggcatatagaaaggctgttggtttttactattttatattgtctttagttacattaatgaacttttattctaagagttttttcaggccaggtgctgtggctcacatcactcactaatcccagcaccttgaccacctgaggttgggagttccagaccagcctgaccaatatggtgaaacctcatctctactaaaaatacaaaaattagccaggtgtggtggcacacacctgtaatcccagctactcaggaggctgaagtgggagaatcacttgaacccgggaggcggaggttgcagtgagctgagattatgccactgcactccagcctgggcgatagagggagaccctgtctca

SEQ ID NO: 412059 - DNA, 409 bp, Homo sapiens
aacggatactgcttaacttgagaagagcctcagttttctcatctatataagatgtgattgctatgaagcttccataaggtaagtgtgtaaaaaccatggcaaaatgcttgtaacttaaaacagagtgtttctatgaggcttctataaggtgagtgtgcaaaaatctggacacaatacctataattgtttaagtgttcagtatgtggagaaggaggattattttttctcatctaatttttagagcgagttcataagattggtgatactcatatatcttagacaatcaaaccaataatcagaaagaataaatagatcaccagcgtcacaaagcagttcacaatgcattcactgggtaatttttagttgaaagtagaaatgatgatcacattgaaaattttgtattatgttg

SEQ ID NO: 412060 - DNA, 527 bp, Homo sapiens
actatctccaggaaagaaaaattacagatcttttttttttgagatggagtctcgctgttgcccgggctggagtgcagtggtgcgatcttggctcactgccgcctccacctcccaggttccagcgattctcctgcctcagccttctgagtagctgggattacaggtgctctctgccacaactggctaatttttgtatttttagtggagacagggtttcaccatgttggccaggttggtctccaactcttggcctcaggtgatctgcctgccttgacctcccaaagtgctgggattacaggcgtgagccaccacacccagccaaaactacagatttcttgtgcactttctcggtgtcacagcttagccctctccagtggggatggcatcccttccaccttcaggaggacactgtgaccttagtcctccaggatgctgatggcttaaacagaactcatcagcatctgaaaaatgtttccttgtagaaaaataaacattttatttttataaaaatggaataaaattttatt

SEQ ID NO: 412061 - DNA, 493 bp, Homo sapiens
gcaaagtatgcataaatacagcaccttcaaatgaaacatccagctacttgcattgggactaatttaaaaaacaacttaagttatggagaatgaagtaaaacaaggcaggacaacaggccacctgggaacaacatggagccaagggaacctccccacccagtaaagcagtgagtgcatgtgggccctgggaacccatgattctcccacagatctttgcaactctcaggtgaggagataccctcatgaacccacttcatcaaggccttcagttgaacacacagagctacatggagtctcagcagagcagccactcgggcctgtgcagagactcaagagccttagatactctggctttccaggcttctccaaaaacgtagctacaagtccagcaaagcaggaggttacacacctgtacataggaaagaggaatttcctattcctctttcttcaggctttgaagagtccaagttgactgggggcagaaaggatctcc

SEQ ID NO: 412062 - DNA, 348 bp, Homo sapiens
ctgtgatcatagtggactacgtccttgaacttctgggctccagcaatgttccagcctcggcctcctgagtagctgggactacaggtgcatgccaccatgtctggcctcatttcattgttattttacttcaaatgctttattttaaatgttaaaatatatgtttttatattcaaaagtgaaaccctatttgatcacagaagacgttaaaatgcacagacagttagaaacatcacctaggcctttctttaaaaaatcactgctattatattgttgaacctttgtagactgcagtgcaaatggtggtccctggagctgtcttgtgcagtggtgctgattttcatttcgtta

SEQ ID NO: 412063 - DNA, 668 bp, Homo sapiens
caggactgtcactggccacacttggcattagcttcacttgagattataggacaagagccaaagcctaccagcagagaggcctcaggtgtaccccttctgtgggaatagtgcttgcagtccacacagcaggtcacagagctgcctgggagctgtttgttctcccagagggtggctcaaatgcaaggagaatatatcccattaatagggtgtgggggaatcctgaattagaagccttgcctctcagaagctatagattttaaggtagctgcctagtaaatattttatcagatatagttgtgtacctatccttccttaaaagaagagatagtcatgtatatgatacaattagctgcttatagtataattaagaaacataagaaggtttaggtaaagtgctatggatctttagaactggtaaagattacttttagcaggggagatcatgaatgatggataggatttaggcattccaggtggaaggaacaggagaagcaaagtaataaaaagaaagatgtggataggaaagagtaatttcagattggctggagataaggtttgtttcacccttcaggaattttgaatagtatgggaatttctcagatattcagagaacatgctgttcattcattttaagaaaagtttgaccactgattacatgcatggtccag

SEQ ID NO: 412064 - DNA, 972 bp, Homo sapiens
caaaacttctgaacaggtgagggaaaagactgtggggcttgtggggctgagattgccagggggccattttctgccttgcagtgtaaatgtgcagtgcttatgtcagcgagaagcctgtcctttcagtactaacatttgaagaatagtttgtggaaacaccacagttgactttcttatcatcctttccatttgagcactggactatggggtttgtctcataaatttctgaaactcaccagatctatagggaggtgttgaaatagaaattgggtgtatactaaatgctagatttgggcagtatattagtcagctgttaccaccatagtgctgtgtaacaaaacaatccaaaactcagtgacataaaacaataaacatttatttttttcttaagtgtcttaggttcagttgattttggctgaacttggtagaactaggcttcgagctgcagactgggtctagatctgttcccatgtctcttgtcctccttgacctgaagccatctcaggcacatttatagttaaaggcaggaatgcaagagtccaaaatctaccatacaagtgcatttcaagtctttgcttgtgtcatattctctttcatctcattggctaaaataagtcacatggccaagccaacattagtgaggcagcaatgcctcctatgaaggttgggagaggagaatgaatagttgctgaacaataattaaatctaccacagttaggcattatgcactacttgaaaaacacatggttctttcattccttgggcccccagtctaatggaggaaacacagctctctgtcattagggaactagaaacacaccagataagatgatgctgctgtgggagaaaaggcaggagctggacagtagggccataacgatgcagtgtgttaccctttcatctgtacagcaatatgcacagggctaagaggatttttaaaatgatttgggtgctgttagggaattcttttta

SEQ ID NO: 412065 - DNA, 270 bp, Homo sapiens
ccccaattggtcacatgaatgccaaacatactcttccctgctcatattatatagcagcaactttacgtcctcatgataatctagggccaattcccactgtcagtatggtaactctttttcatacctgttgatctattggcagaaggagcccaagtgaccagccaatacgtgtagctttaggtgtagttggactcttgctacgtctctttgtggaagtgatccccatctgggaactggatcttctagatgcatagatcctaaggttgtaga

SEQ ID NO: 412066 - DNA, 560 bp, Homo sapiens
cttcctttttaagtatatatcattttttctagacttttctatcagacacatttgctaaatttatgcatattttaaatcaaattatctgaaatattttaattaaagtaaacatgtttccatttggaaaattttacagcattaaaataagaaagagtaagcatgatatttataggtaatgaataatacataaccaattttatttctattttgcattataagtaagaacaagatagtaatatgtatatatgcagtttattactataaatgaagtaattataaagtcttattgctaaaattttgaaatgcaattttcttttcttgcttttatttcttatttctccagtccaatgctattttggaaaatattgataacaaataatcagtaagaatatatttaattgggagtttttatattctttctgtttttctattatttttccttttttcccacattgattatacctgtttgtatttcagtattttgtattccacgatataggtcaccatcttttgaatagtttagatcatttgagtaaatatctagttaaatatcttttatc

SEQ ID NO: 412067 - DNA, 678 bp, Homo sapiens
caatctcggctcactgcaagctctgcctcccatgttcacgccattctcctgtctcagcctcccaagctgtttggactacaggcgcctgccaccacacctggctaattttttgtatttttttagtagagatggggtttcactgtgttagccaggatggtctcgatctcctgacctcgtgatccgcccacctcggcctcccaaagtgctgagattacaggcgtgagccaccacacctggccgagttatgagttctttatgtatcctggatatgagttgttatatgtgtgtattgttaattctttctcatggccttttcattttctttagtccatgtgcattttttgcaagtaagttttgaaattatttagtttacatctcccatcctactgtttattctttatttgtcccatttgttctttctccttttttctttccttttggaagtatttatcagtgttctattttatctcaacagttggtttattagccatgtctttttgttttgttttgtggcctgttgtgttggttttctccagcttcttccttccttttagttttggaaactaaacccagaacatatgagaaatattttcaaatatacagggaaaaaaatgatagactagtgtcctaatttctgtaccaagtctagattgaacaaatgtgaagattttgccatat

SEQ ID NO: 412068 - DNA, 596 bp, Homo sapiens
agcttgcagcagggctgcggggcactctgtgaacactgaatccagcccccttgttttgctgatgagaaaaaggaggctcagaaaggggcagtgatagctctaaggtcacacagcattgctatggcagatccaagatgaggacttgagtccctgcctcctagcccagggtctctacctgcaccatgcgccccacctataggacctgctcttggctaatggagcaaataagtctgtgaatgaatgttgggtgtttcagggcaagttacccttcccttcccatgatccaccaaacaggaggaggtgtttatgttcactgtgagggtggggcatgaagtactctaggacacaccagggtgtgtgtgtggtgtgtgtgtgtaataagtgatgctagaactcatgtattaaccttctgtgctggggctgtctccacaacagcccatttcaacctcacacttgcattcctcacttcacggaagctagaaatcagagagagcaagtgacttgttcaaggtcacacagcaaataagcagtagagctaggcttccaagtcaaagtctgtctgcctccaaaacctgccctcataccagcagctaaga

SEQ ID NO: 412069 - DNA, 559 bp, Homo sapiens
aacaaaagtatcaagaccacatcatcttagtctcctctgacatgaaaatgcctgtgctgagttctgatttaatatgttatttgtctgtatagaatcaatctgtaagaaacatcatttgaatgatgtgcattttctaaaattttctaaaattatatttgaaactatagtcctaggttcattgttctttgtacaagtgcatctaattaagatagaaaaattacatgttttctttttcttcttactgaaaaatgaaaacttataacctggaaaacatggacccaaatttgacacttggtgtttgtaatttgctgatatcacgagcttgatagtatctttttcaattgtctacagcagtgatttataatttttacaattctggggatcaggagtttgagcagggctcagataggggattcttctgctctgtgtggcatcggttgggatcacttactcagctggtaactggtgtgggctggacagtctcaggctttcttcacatgtctgacacttttgtatgcctccacatggcatctcctcagcattgtggtgtcagagtagt

SEQ ID NO: 412070 - DNA, 604 bp, Homo sapiens
catgaattttgttgctttgcttttacacatcactggcctatattacaacactctaaactcagccacttccttcacccaaaaaagcaaccgcccataattgcttacccctcttagggaacgatccataccctgcacagacttagagattcccttggagaactgatttaattgtggttttagattattcacacttaaaaagtgaaactaaaaattgccaagtacagtcaggcgtggtggctcatgcctgtaatcccagcaacttgggaggctgaggtggggggatggcttgaggccaggagtttgagaccagcctgggcaacatagtgagaccccatgtctaaaacaacaaaacaaaaaattttaacttagctgggtgtggtagcacatgcctgtagtcccagctgctgaggagactgaggtgggaggattgcttcagcctgggatttcaaggctgcagtgagctatgattgtgccactgcactacagcctgggcgacagactcccctggggtggggcgggggggaatgctatgtagactatcatcatagtcaaagcttttctcagaaatcgtattcatttagtttggctaaattaattgccccct

SEQ ID NO: 412071 - DNA, 544 bp, Homo sapiens
gttttgccctctttaaagtttgtataatatcgcctttcattacttaccccatagagtgttatgacagacaaataaggtattgtaggtaaaagcatcccataaacattaaagtgctagatatacgtaaagcttattattccggtgaccccctcttcctattccccactcttcatctcagttccttctcttgactgcccaaccccttgaccccactcccaagaacatcctcctgttctctgtgtgttcccactcctgctctcactgcatcctccctccttgcttagatcaagatctaaaacacttgttgcatccttttttgagacagggtttcactcccatcgcccaggctggagtacagtggcacaatcatggctcactgcaacctcaacttcctaggatcaggtgattctcccacctcagcctcccttgtaactgggactacaagtgcgtgccaccatgcccagctaattttttttttttgaatttttagtagaggtggggtttcgccatgttgcccaggctggtctcaaactcctggtctcaa

SEQ ID NO: 412072 - DNA, 319 bp, Homo sapiens
gtacagatgaggtgtttttaaataactggagtatatgtattcaatggctttatccaactgctaagaaagtgaaacaggaatagtggaaaaaataagttaacatcattcccaggcatgttggtagtataacatgcactgcataatgcaaaatcagttaggtatattgggtgattctggaggacacagagttaccatttccttccttcctccctccctccctccctctctatctttctttttctttttttttttttttttgagacggagtttcgctcttgttgcccaggctggagtgcaatggtgcaatctcagctcactg

SEQ ID NO: 412073 - DNA, 702 bp, Homo sapiens
ctctctcaaaaaaaaaaaaaaaaaaaaaaaattttcagcaacatttatgtctcaaatctttcaaagctctcaacttaattttcatagaaataacaacaatccacttttggtaatcatattagtcattctatataacagttcttaaattacatcaattacaataacaaagataattagcataaacaggtttggaaacatctactgacttttagtaaacagacaactactcggcgcagaatcatacagtcttactaggagttaatccacttgtcagcaggcctcggcaagctctgaacttcattccatatatcttacagagcaattggagagttcattaaagtgcacttaactatgaagataggttaccttctatggttgtgtaatattaatattgtaatttaagatgtttatgttcaggtccagagagccttagcacacaataaatatttgataaatattagccatttacatttcatgagaaagttaaacatttttaaatgttttcagttcataaagacttttgtagcctgtttaatttgcaatcgacatttctgggataagaggaaccataaccagagagcataaagactaacagtggtgagactgcagaagtcaaagtctagtttattccttctattcattattttaacaaatcaacacatccttttttcagtggctgctctttgccagcctctgttctca

SEQ ID NO: 412074 - DNA, 954 bp, Homo sapiens
ccgcgccagtgcccgccggggtgcggcgagacagaacctgggagcgcggcgcgccgggcagcccgaggcaccgctggtggcaggcgctgcgcttcgccgagtctgggcgcctggactggaagaggaggcgagagggagagagcggggaagaggaggaggaggagcaggagcaggagcatgggcaggggcagtctgctaaatcatctacgcagaatcttcaggtattggatcctgatacagaccagatattctggaattctctctccaacaaaagattacttcaaggccagaacacactcccagctagagatccaagtgaattcctatgaagtatgcagggaagggcaatgctatttttttcaacagaaaaataaccctgtagtgaagatgatttgctcagggtctcacagctagtcaccggggaagccaggatttgaaccccccatcctctcagacctgcttttaacctgacattttgatgcctgtgcaagtcatgggacttgattctagagtaataatggaaaggaattatatttgtgtcaaatagaataagatgcaatttccatttttaatgtctaaaatcgttgaatattggcaatatcatgtagttctacttaatatagatagccaagtactgtggggaaatagtgtagattttagcatctgactagcctaagctagaatcccagctgcacctcatgtcagaattgaattacttctatattgtttaacttttctaagcctttgtttaaccttcctaagcctttgtttcctcatttttaaaaatggtggagaatggtacttcctttaaaggtccttatgaagagcacacagtgccatgtctgcaaaaaacctatctcagtatatcagtatattatgcatagtaagttgtaaatagaacacagcagatattattgccaataagggattaacaaataccaaattggaaaataa

SEQ ID NO: 412075 - DNA, 684 bp, Homo sapiens
gcccacaaatgttcatagcaggtttattcataatagccaaagactacaaacaaccaaacgtctataaacaaagtcataatacattgtgatgtattcatatgatggaatactaagcataagaggaacaaactactgatacataccacagcataaacgaatctcaaaagcactggattaaataaaccgctctacaattctgtatgaaggtctgaaaacactaagctaatctgtcgtattagaaatcagaacagtggcttctttgcatagtacagactgagaagggcacagggaactttctggagtgatggaaatgttctatatcttgactgaggtgatggttacatgagtacatacatttgtcaaaactcagaattgtactttaaaatttgtacattttactgtatgtaaattaagcctcaaatttaaagtacctttatttatttatttgtttgtttgtttatttattgcagaatcttgctgtgttgcccaggcaggaatgcagtggtgcaatcacggctcactgcagcctctacctcctaggctcaagcaatcctcagcctcctgagagtagctgggactacaggtatgtgtcaccacacccagctaattttttcattttgttgtagagataaggtcttgcttaaaatacctttataagccaggcacaaaaacacatactttgca

SEQ ID NO: 412076 - DNA, 428 bp, Homo sapiens
tccggttttaaaatggcggcttgacttccccgccccccagaaagccaaaaacaaatatgcagcccggagattttcctcagcgagaatccgaagctcagatttgaggatgagacagatcctgggaccacggagaagtgaaaatcttccgagcaggcgaatcttgctgtgttgcccaggcaggaatgcagtggtgcaatcacggctcactgcagcctctacctcctaggctcaagcaatcctcagcctcctgagagtagctgggactacagctcctctctcgatcggaagatttttacagacaccctactgatctttagggatttgtaaactattacccaggaagaaggcccatggagctaaggcctcagaacaccaaagtctggactgtctgagggcacatgctaataacaggaggctggcaaagtggc

SEQ ID NO: 412077 - DNA, 893 bp, Homo sapiens
  misc_feature (475)..(475): n is a, c, g, or t
  misc_feature (513)..(513): n is a, c, g, or t
  misc_feature (590)..(591): n is a, c, g, or t
  misc_feature (650)..(651): n is a, c, g, or t
  misc_feature (653)..(654): n is a, c, g, or t
  misc_feature (713)..(713): n is a, c, g, or t
  misc_feature (750)..(750): n is a, c, g, or t
  misc_feature (892)..(892): n is a, c, g, or t
aacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtaccccgccaatgggatgggcccactgaaggtgcttagcggctctgaggtgaccgcatagacttctcagaccaagggacctggatgacaggcaatcaaggcctgagcaaccaaaaggagtgccccatatggcntttctacctgtaacatgcacatagagccatggccgtanatttataaataccaagagaagttctatttttgtaaagactgcaaaaaggaggaaaaaaaaccttcaaaaacgccccnnaagtcaacgctccattgactgaaaacagtccctatcctagaggggttgagccttcttcnncnntgggttggaggagaccagggtgcctcttatctccttctagcggtctgcctcctggtacntcttggggggatcggcaaacaggctacccctgaggtnccatgtgccatgagtgtgcacacatgcatgtgtctgtgtatgtgtgaatgtgagagagacacagccctccggtcagaaggaaaggggcctgaggtgccagctgtgtcctgggttaggggttgggggtcggccccttccaggnc

SEQ ID NO: 412078 - DNA, 528 bp, Homo sapiens
gtgaaggacaaggtttcatgaatctggctccagatagagaaatatgcaaaaaggtagctttctagcacaattaggaaggttttggttttagaagcagtagtagtatggatgttcactcaaagtagaaaggagcactttgtatagataaaaactataacagaagtacacagtacttggagtgggcaaggcagccatttcttactcatgaaatcaccaggaatacccttggaatctgataagatgtgtttattgtcagaaaaaaatagatgaaaataccaagaatattcttatcacaaattaaaacctacaaagaaacaataattacttaaatagattatagctcagagaccaaccttatgggcaaacaaaggaagtataaaagaagaaactttgtaaaccaagggatgatgagaataccttaatgttgctaggaaaaactggttggtaatttgaaatgcaggtcagtttagagccaaatctcactctatacattatatgaaatgaaatattgagaagattagtccatag

SEQ ID NO: 412079 - DNA, 532 bp, Homo sapiens
ggtgacattattttttgttaaaaaaattttttttcttaccaaagaagaatcctagaaggtaaaattattttacaattcttttcaaagggctaaatgaataaagcagatgatgtctcttgtgggacgatatatgtaactatttgatataaaacctctttaagctgcttagaagattagactcaaaagaacatacagattaattctaaagaagagaatcccaaaatacaagggcaaagaggcaggattgccttttgctttcatatctgcacttttacctggcaataatgttaaaatgtgtagaggaaatagtcacaatttaaaatgtttagttccagttatttagtgaccatctaaatatactatattgtatatatagaaggtaaaagtaatgaatttattatttatacaattagtgttatatataccaatgttgtgaaatacttttggtaacacttcgtgggagcattaacccttttgattccttgttagagtttgaaataaaggcttctagagtaaaaggagatagttcttt

SEQ ID NO: 412080 - DNA, 584 bp, Homo sapiens
ggccatgtgggcttcttcaaatattcatctgtttcagctcttttagaagccatcgtgaaaatagcttccaacactctgccattgtgtgcagtagtgctaaaatatttgaatgcttgcaacctcacaccaaacactgcaagctcaatacattgctaaccaagagacaaagcttgggattttgtaactgataacactctagtgatattaatcaaactgtataaatctagttaatctaagagtatataattacatctgagaaggtgcttacagaattctatgcttctgaatgattttgaacaaagaggtttatatactctttatggacagcataatgcaaattgaaaacaacttgttttcttctctttttataatttttatataattttcatatttttcaatttacaatacaaatatcaatgtgttggcatttacatttcaaagagattaagtagtgggcaaatgatttattcaaaaataataaatgtatgtattttacttacagtacttactagaaatgaaaagagcggaaagagacattaaataccaatttactagaaccttagactgtttggaaggattctatg

SEQ ID NO: 412081 - DNA, 719 bp, Homo sapiens
aaaaagtccctccccccacctcacagcatatgaatgcgttctctactgagtaaatcaagcctgagctttctcatgtgggctcctctgtgctccatccacttctctcttggaagacagggtgtctttctgccttccaaggctgatgcctctcgtccccctcccaggggctgcaccctcagccacccccagctggtgttttcagtttgcttctctgataggtggcctcttttatcttctggtttgttgctgctgccttctgaatttacaggcagcctgtggatccttctgttggtatttttctctcctaggtgaactcttggaaggaggtggtcggcattcactgttacctcgggccctttccaccttggcactgctcatcatgctatgatttggctcctatcctgcccactctaataaacaatcacgagtttggcagttctccttattgccaaatttaatggtcatttacaactcgttttcctgaactcttcttctttttttgacaccatagacgtctctctctgtgtcactttctgatttttcttccattgattctctgacttggctcctgaactggttcctgatttctcctgcctgtcactttagttgttccctaagagttggttcttcacctcttaacttttccaggacttttgtttggaatttgacactgttgactatacacctctttcttgaaattgtctgtcattcatctccat

SEQ ID NO: 412082 - DNA, 658 bp, Homo sapiens
atcgcttgaacccaggaggcggaggttgcagtgagccaagatcacgccactgcactccagcctggccgacagagtgagaacccgtctcaaaaataaattaaaaaataataaaaaataaaacaaagtagaccatagatctaaatgttagagctgaaactacaaaacacttgaagtaaatacaggagtaaatcttcatgacctgagttaagcaaagccttcttagatgcaagaccaaaagcacaagtagcaaaagaaaaaagtagacaaactggacttcatcggagattaagatttgtgcttcaaaggacaccatcaaggaagtaaaaagacaaaccacagaatggagaaaatatgctgctgggactcgccacctcctgccgtgctggtgggggaagcgccaggctgtaggtggggtctggcctggtctctgcccagcaaactggctgtgctggcccgggcaatccctctcctcctgggtctgtttctggggctatggagttgagggtggagccagcagcaaggggacagggctcgctgggggacccgcctgcctgtgctgctgccaggagctctggaacttccaatacctggcagcttctttgcctctcagagttgcagcccttgggtgatgttgcagctcacatttccccatttctga

SEQ ID NO: 412083 - DNA, 299 bp, Homo sapiens
gccctgtgcaatcctgagaaagtctgtccctctgattcttctctctgggattcagtaatatttaaaaaacacttcatggtacttgagatagagtcagggatttgaatgaggtaagcactaacatttgccagttgttaactttgtgtaagtggctacatacacctccccaagcctcagtgttcctatctgagagggggtttttttttgtgtgtgggtgggggaggcggggatggagtcttgccgtgtcacccaggctggagtgcgatggcactatctcagctcactgcagcctccatctc

SEQ ID NO: 412084 - DNA, 706 bp, Homo sapiens
gtttgaggattaacaaagatttgtattgggccacatatcttgaaaataccaaggatgtactatgcctattgtaaattaaatttggctttgtctcctagcattagaattttttatgaccaacactaggagtttagttatgataggggaaaaaggataaatatttgagtaccttgtttatataagaataacttcttttttttctgcttagggaagcattcagtggagatcttaataaggattgacttttcttggtaacagaattgatatcagtggtacatgacatctatgcagccagacacaaatctgaactcgttggaccctaaataagtgtttaaatatttgttatatttcccaaaatgattggtttgtaagatggttaatagtaacttatgcaaaagtccagaaattaggtgttcttattcactgagaaaagtctgccttaaaaattaaactttttttttctgatattaagagcactatgaaaatatatagaataggtgttaatccttacatttttccatgcatttctatacatgtatgtacagatgtacaaacatcattttagggtttaatttgttttgttttcccttagtggggtaatacaataagtatattttccaactagcagattttttttttttttttttttactgcagcatttctcagagtttgcattatgccttgtgcattgtgaatctccaaaaat

SEQ ID NO: 412085 - DNA, 760 bp, Homo sapiens
gtttgaggattaacaaagatttgtattgggccacatatcttgaaaataccaaggatgtactatgcctattgtaaattaaatttggctttgtctcctagcattagaattttttatgaccaacactaggagtttagttatgataggggaaaaaggataaatatttgagtaccttgtttatataagaataacttcttttttttctgcttagggaagcattcagtggagatcttaataaggattgacttttcttggtaacagaattgatatcagtggtacatgacatctatgcagccagacacaaatctgaactcgttggaccctaaataagtgtttaaatatttgttatatttcccaaaatgattggtttgtaagatggttaatagtaacttatgcaaaagtccagaaattaggtgttcttattcactgagaaaagtctgccttaaaaattaaactttttttttctgatattaagagcactatgaaaatatatagaataaaaagtagaagctatcttctgcccactgggtagaagtcggcttatcctacattgggtgttaatccttacatttttccatgcatttctatacatgtatgtacagatgtacaaacatcattttagggtttaatttgttttgttttcccttagtggggtaatacaataagtatattttccaactagcagattttttttttttttttttttactgcagcatttctcagagtttgcattatgccttgtgcattgtgaatctccaaaaat

SEQ ID NO: 412086 - DNA, 560 bp, Homo sapiens
tcatgacattaaaacttggtaatttcagaaggagaaacaatgaacaccttaggtcttgccagcctataagctttgactacacctgctctgcctccgccatcctgattccttcctaggctagtagaggccactcactcactttgcatttggatggtaattgcctatgctcttgaaataaataacaaaggagggggcatgcctggcaggctcctgtactgggaaccctttgagaatgaggacacctaagcagcagtggacatgccttgggccctgcttctttcctggattttggaggctcttgtagccatgaagtctgcacaggttgtacttacttcctacagatgctcagagctcctgaagtcactatcactccacaacctggactcagcaggtctgagaggctgcaaggaatggaagtacagaaaagacaaaagcctcaaagggaaggcagaagaaagcaatacagcagaaaaggggtgatgcctcagaaatagcctagggaagcaagatatgggagacaggatgaaaaaacctaatggcgtcattaaagcagagaggtg

SEQ ID NO: 412087 - DNA, 439 bp, Homo sapiens
atatgcactgggaaaccaaaaaattcatgtgatttgttctattgtgatactcgcttcattgcagtggtctggaactgaacttttacttgaaggactaatatttccattatcagggcctcattccatacctcagtgaccaaggatagccactgggacccaggctgagtcaatcacagcatcctgtcactgaccacagggacagccaccaaaatgacctttaacttcttcccctgccccaatacctaattagagctggtataaaagacaccattctctctcttgtcaaaagatgtaagaatacatccctatagaggtccaaagccttggtcctgggtcttgtagagaagctgaccttagagaatggtgtggccatagtaagagaagcaggcaggggaaagaagagagtgacctgttggttctgaagtttctgaacccaggc

SEQ ID NO: 412088 - DNA, 420 bp, Homo sapiens
gcagtatggaggtggagtcaccatctgttctcaaggatgggaaacagactttaactgaacattaggaatgagctgtattcacctggcattggtatcaggcgctggatggattacaccagagaatacattacattaggaaacacagtgcctggctcatggtggaccagagacagatggatggactgttttttgatgtgaagactgaattagccctggcagtgctgtttcccagggccctatctctgggagtcctcctgctggaagggaagtgctctcatagctgatagttaagacatgtacagtcatgcattgcttaacaatggggatacattctaagaaatgtgtccttaacacaattttatcattgtgtgaacatcatagagtgcacttaacacaaacctagatggaatagcctaccac

SEQ ID NO: 412089 - DNA, 868 bp, Homo sapiens
tttgatctcaaggcacattaagccatctattgccagttctcatactcatcacaaagttgccagaatgaaataaatcgaacctgcataggtttacaaggaaatgataaaactggtttttcttccgctgaaggtagatatgaaagtgttctgtctttgtgaatttggagagaatgttggaatcagcaggtttgattcatggtctctaaggtctcttcaggtgttaagcatctgcttttatatctttttccaagcagacctgaaacagaaggctttggtgtggctgatagtgttggatgagaatttatgttatttcagcctttcttgcttacatacgtatattgcatgtgtctattgtagactcagaaagccattatctttcttcttgctttcttctgagctttcttcttgctcacaattcactgaaagaatcagctcttctcagtcaatgcctgtttgtgctatggccaactcactgtggggcagtggaacatgcccacttactgtggggatgtgtattgttctttactgggatatcttgaaagtacaccagtcacctcaaaactcccatgcattagttacttctactaaggtaaaatttactctccctaaaatttactgtttttaatgtacaaatgataaaacagctctttcacactttaaaattctcttgtgtccctttgtaataaactcctctccccaccccagtccctgccaatcctgatctgtttttgtccttagagttttttttgttacttttaaatttaagctccctgaaacttatggtttcagcgtagttgagcactaatagtttccatggaaacatatcctccatggggcgctgggatatttggtaagagagtagtgatga

SEQ ID NO: 412090 - DNA, 337 bp, Homo sapiens
cacaccaacaatgcactgctggtttccaaccttgctgattcggttgaaatgatccaccacactgagcagcaccggaaggtggaccactgccttctgcactgccagctctgacatcttgacacacaccgcccactaggcctagctccctgcaacccacaaactccagcagtagcagcaactcctgtgaagactacttaattttttaatgaaaaaaatgtgtgtgcatgggcaggtatgaatttatgtatagtcatgcattgcttaatgatggctggatggtgtagcttactacacaacctaggctattcgtcatatagcctattgctcctaggcttca

SEQ ID NO: 412091 - DNA, 813 bp, Homo sapiens
catcctttgttttccatcattgtctcactaggaccttgacgtcccacttaaagtcactttctcccccataactcctaccatcattctgtgagatcccaatatccatatggttgatgtatccattgccatagctaaagaatttctgcgttcctcaattcactccagcatcatccatggtgacacccagagcttgctatcacccaccatggtttcatcagaaaaatcattgactctgccatcccagcctctttctttacagcttatattctcatgtttatcacatacaccataccaagggtttttatatttctggtgttgttgctgttttattttcgctttaccttaaagggatatctaaattatttatttcccctcatttttctgccagtcttttcagtccctgttgcctcactttcttcctggaccgaatggttgacttatactacattaatatatttatttcccttgacccccagtctgctgcattgtcccagtaaaaatcctaaccctagattgagctctcacactgctttctctgctttttaatctctgcacttgagccctgctacaaatggatgatttctatttctgttagggcctcaacatttcaggaaaatctttttcttttcatttctatttcgaattccctcaatacatactccaaaccttcacctctcttttcaatacctgctttactcactcacaagaatgactgtatctcctcctccaccaagggaattgaaattgaagcatattcttttttaaactctggctccctcaactctaccacctttaacttacttagccaatagc

SEQ ID NO: 412092 - DNA, 760 bp, Homo sapiens
catcctttgttttccatcattgtctcactaggaccttgacgtcccacttaaagtcactttctcccccataactcctaccatcattctgtgagatcccaatatccatatggttgatgtatccattgccatagctaaagaatttctgcgttcctcaattcactccagcatcatccatggtgacacccagagcttgctatcacccaccatggtttcatcagaaaaatcattgactctgccatcccagcctctttctttacagcttatattctcatgtttatcacatacaccataccaagggtttttatatttctggtgttgttgctgttttattttcgctttaccttaaagggatatctaaattatttatttcccctcatttttctgccagtcttttcagtccctgttgcctcactttcttcctggaccgaatggttgacttatactacattaatatatttatttcccttgacccccagtctgctgcattgtcccagtaaaaatcctaaccctagattgagctctcacactgctttctctgctttttaatctctgcacttgagccctgctacaaatggatgatttctatttctgttagggcctcaacatttcaggacttcacctctcttttcaatacctgctttactcactcacaagaatgactgtatctcctcctccaccaagggaattgaaattgaagcatattcttttttaaactctggctccctcaactctaccacctttaacttacttagccaatagc

SEQ ID NO: 412093 - DNA, 637 bp, Homo sapiens
tttcttttttggtagagatagggtcttgctatgttgcccaggctgaactcaaacttctggcctcacgcaatcctcccatagcactgagattacaggtgtaagccactgtgcctggctggaattttctaagtcatggtgtagagaggccggctatcctctaatgcaaagcaatgccaggagccacaagtcaacacccacgagccactgatgtgccggccaccagtcaacacccatgagcattaagcctgcacaccactgagaacaaagagaattaaatcctctttacccttagcaaagactaagtttcatgaaatttctgcagggaagaattcttgcgtgagacacatgggatgatttatgactcagtgtcccgaatggaagagcctggtgttccagacacgttccagcggctcccggtgttcccaacatgctccggtggctgtggacaagtgggccttgacggcaccgaactccgtaaaggtctcgtgctcctggagcgacaggctccatctcaccgggaggccacgcagcagaggaagtgcgccccgctttcaaatgattaatccgatgctttaatccacaaggcaggaaattttatgttctaaattagttacattatacccaaaacctatcagtg

SEQ ID NO: 412094 - DNA, 550 bp, Homo sapiens
gggtatagcaatggactcagccacttagtattttaactccacacattgctgaagtgactattaaccatttccaaaaaacaagttacttgttaactttctgggaaataatatttgctaaagcattagtttatattcctgatagtgatagtggttgtgggaatgctagaaaatatgtatcttttttcttttgttttctataaaaccagtggatttcaactttttaggaaacattaaagataaaaagaaactaagacatcctgtgcatttcctaatctaaaacagactttttaagagtgttatcatatgtgctgaattttacaaaattaaatcagatgaaacatactcattatttttattttgaatttgtaatctctttaatcaaattaatacaaagctatacagattattaacatcttaatagtttttttttactattattccaatttaggatgaatgccatattgaaaaaataagtaatttatgaaggacttttattgtttgtacttcactaattgaatagtttatgagttacctggtaagacaaaattta

SEQ ID NO: 412095 - DNA, 413 bp, Homo sapiens
gctttggtatcaggatgatgctggcctctgtcttctgcatcaatcacgctgggagctgcagatgggagctgttcatattcagccatcttggaatggactcccagtgagggaatagtttctagcagccaaaagattacatcctgctgaaggattacaacatcatcaggactgcattttcatcaggaatgaatattccttctacaatgcaaagaaaaaaaacccaaaatatttgctgatggaaaggtaaaaggagaaattttctttggttttaatgtttaacttttttattgtcacctgttaaaaaatgcttactagtcattcctttagcatcatgtgagagaaagatgtacaatgattgatcatttatatgacataaaataaagatgaaacatcatcacggcatgaacaaaaac

SEQ ID NO: 412096 - DNA, 564 bp, Homo sapiens
atggagtctcactctgtcacccaggctggagtgcagtgccgccatctcagctcaccgcgaccttcgcctccagggttcaagtgattctcttgcatcagcctccccagtagatgggattacaggcacccaccaccatgcccagataatttttgtatttttagtagagacgggggttttaccatgttgacctggctggtcttgaactcctgacctcaagtgacccgccctcctcggactccctaagtgttgggattacagatgtgagccactgtgcccggccagcttctctctttttacaaagacatgcatgtattcctgcatcacaaattcatagactacaggacaaaattatccacgaatgccaaaaattacaagtagaacaatgctatatgaaataaaactttgtaaatagaaattattttaagcttccaagtgtaatgattcaagttcacaaaggctaagagaagggatgctacaataaaataacacttcccagtaaacccttaggcttttaaattgtggtctcttataaaatggggcaaaatattacctatcatagttata

SEQ ID NO: 412097 - DNA, 596 bp, Homo sapiens
aaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattctt

SEQ ID NO: 412098 - DNA, 438 bp, Homo sapiens
  misc_feature (435)..(435): n is a, c, g, or t
caaaaaaaaggatgtggccaagtgtaaagaaactttgaaggaaatagtgccagttatagaagaagaagagcccagcttgagaatgaggactcagctttcactctggctatgccccaaatcctgggtgacaaccaggagtgctcttgtctttctgagccaaagtctctccatctgtacaagaaagatggtgcactccacaatcagattctgatcctaaagacatttgaatctttattcttggtggtcaagtcaatttgaatctttattcttggtggtaaagactttgttattttcaaaatcttacaaggacctaacaggaaactttaggattctttggagtatgttgtaaaggcatacctctcatctttaacaatgtgaaatgaagatgacagaagggaatcacagcatttcatggcatttgactgataacattcnaat

SEQ ID NO: 412099 - DNA, 477 bp, Homo sapiens
agtagtttggagatttctcaaagaactaaaaatagaattgccacctgagccagcagtcccattactgggtatatacccaaaggaaaataaattgttctaccaaaaagacgtctgcactagtatgctcatcacagcaaagttatcagcctaggtgccctctaccagcagattggatagagacaatctgggatccttttggagttcatgagtgtgagaactgggtgttcacccgcatgtgtgagatgtgccacccgcaaaccttgttatgacatcagcacattactgaaaaaaaaaatctggtacatatgtaccatggaatattatgcagccataaaaaataatgacactattgctgggcgcagcggctcacacctgtaatcccagcacttagggaggctgaggcaggcagatcacgaggtcaagagatggagaccatcctggccaacatggtgaaaccctgtgtctactaaaaataca

SEQ ID NO: 412100 - DNA, 448 bp, Homo sapiens
agacttaaagaaatttgggttttgggattgatgggtaatggattatagccctagatccctagagtttcattctgtagggatactttggtggaaaactttaggaagcatgtcttaacatatcaggtaatctttcaaaaataactttattgatatatgatatactacacatattcaaagtgtgtagtcttgatgtatgtgtacatccgtggcttcatcctaacaatcaaggtaatgaagatacttatcatccgcaaaagctgcttccttcccatttgtcatctctcctttcattcctccccaccctccaacaagtatgcaggcaacaactattttgtctctgtcactgtagattactttgcactgtctagaattttatataatagaatcatatagcatgtacttttttgaggggtgtgtgtgtgtgtccaggatctttcattcagcatac

SEQ ID NO: 412101 - DNA, 409 bp, Homo sapiens
ggcaaatccagctaattgcaagaatttctttaaagtcttattatcttaaaagttcatacaaatattacatgctacgttgtggtatataaacatttatttatggcttcaggtactcccttgctaaatactttgagaagcatgacaatctgtcattctccctgattatgttaacccaagaaaagtttagaaaaggactttgggaatgactaaatacctaacctgaatttatacatcccaatatttgtgcaaattatacataaagattttttaaaattttatttttggcatttcattatcaataaggaaatgcattttgatagtagattagaaagattttatatcttaatatgtggaattgtatattaagggagaaaggcatgtaacgaatgaatgtgtatcaaccacttat

SEQ ID NO: 412102 - DNA, 709 bp, Homo sapiens
gatatctttgataaataaccccgatgtaaatgtgggataaatcaagcaatggtgtattctaagcagtgactggcccaaaggatgagttacatcttaataagcaatagacttttctcatattcaaaagaggttgaagaatacaatacaaaaattaagttttcacccaacttagttatataaatatggggagtcctaacactgaagaaaaaaatacgttttaaaaaactagtttgtgagaaatcttctagaataacaatcctactttttatctctctctagtagtctttccctagaggaggttaacgttagatcagaaagttctctgcccagatgtatttgggggagttgtattgaacatatccctttgccacagaaactagtcatctttaaatgtcagcttcaatgttgaaattttatgagaatggaaaggaatacacatttttacttattttagacctccctttggaaaatgtagtcggctgctgttgtctcaagttggaagggtttacaatgttttcttcaaatattcatctcaaatactcatggaaagcaaatgcaatccagaattagacaagaagaataaatgtaccttccctttaaaaaacttattaattgtagcacatcagtcttagtcatttttttgacctttctctcaatttatatttaccctggatacttttcttttgtcttgtttattttaagcatggct

SEQ ID NO: 412103 - DNA, 695 bp, Homo sapiens
ggctgaaacacaattaggtttgctgatttttgttctccagtgcaccattaatttgtcattttaaatatattatataaataaagcagattgaattctgctcttacacatcatagcactaagcatagtatggtacagcagaaaagaaataattctgtctttctttactccttgagatattttctaagcacgtaatatgtctcatcttccaattgagagaagagtaattttcaaggtaggtaagaaagattgcttttatgcctgagttattctttacattataacatgatgtttaggacaacttaattttcaactaagactgagttaagagggttgttttgcttagagaatgcttcctcaaatatccatagagtattaaataaatgttccaaaccataccatcagattttcaaaggccaagagctgaaatatgttgggaaaatccatacgttgattactttctacagcctcagatttgaagatcttgtcacaattcaagcgtgccccatttgatacatgaatttccacatgagaaacaactctgaacatttcatgatagaacagaacagctcttgctcctcttggaggcagtgtggtctcatgtgaactcagacaatcctgagtctgaactcagagaatgacttatctgattttcagttcctgctaaataagaatcataaaacctaactcacagtacg

SEQ ID NO: 412104 - DNA, 684 bp, Homo sapiens
attatttcatggcatttctgcaatcacctattttttcatgaaagcattccagaaaaccctatattcctggtctaattttatctgcaagaaaatgaaatcaaggaaattgtatgataatatttaatagctctgatttctcaacacgcttcctcatatatcttaaaggggggaaaaagcagtcttgttggaatgggtccagaagtttcaagatacaaatatatttttccttaagccattaaacaccataaccaatgggcaaaatcattttatatggctttctaaaatatcatgtcagagttgcaaatttcgtaaacataaataaggatttgggctagcaaggttggtgaaggtcacttctactctcatcttttaaaccatatcttggagagtttttaaaatgcagaagtattcattctaggtgagatttagtaccaaaggtggttttgtttgtttgcatgtttcccaaaagctcatcttttcctccaaaatgtcatagaagatatcagaaaaagaatgaatcataataatgaaaaatcctgaaaatccaaacatttcattggaaaataaacttttccaaaagaaaaaatttctttcatgtatgcaacagacctaggatagtcacttcatctctcataaatcaaagattacaagtcacaatgtggctgggtgcggtggctcacgctg

SEQ ID NO: 412105 - DNA, 322 bp, Homo sapiens
aaactgtagaaaaaaaaaacagcacctttttttcctgaggcaactaactggtttatactttatatctgattttttcccactattacaatttttaatttaaaaagttttaattttagacattatcctacttattagtaatcatgttgtagacttacacttcaatttaactttactgtatattatcatatttattggaaaaaaattaaatattactcagcagagttacacaaagacaagagcaataaaatacagaataatcccagcttttggaaaatattattctgagagatttcattcgaaaagcttctagaatcatcatttg

SEQ ID NO: 412106 - DNA, 413 bp, Homo sapiens
attcaatctggcttcaatttcattttgaaatagatgattccaaaaatgagtatacttgatagtggattaaaacaaaatgagccccttttggaatttaagcttgctatgcttctcttgtttacagtactattctaataaaagtatattagaaagaaggctgggcacggtggctcacgcctgtaatcccagcactttgggaggccaaacgggcagatcacctgaggtcaggagtttgagaccagcctggctaacgtggtgaaaccccttttctactaaaaatacaaaaaattagctaggtgtggtggcgcgcgcctgtaatcttagctacctgggaggctgaggcaggataatcgcttgaacccaggagaaagaggttgctgtgagccgagattgtgccattgcactccagcttg

SEQ ID NO: 412107 - DNA, 396 bp, Homo sapiens
ttgcccttcaatcctttcctgactccatacacttgggatatctgctgctggaacccctgaaacccatgaaatctcatgagagccccctcattactgccactactgcaaatggccctgtgatccctggatccttctgaagaaattctactaagctgtgctggatggcagctggctgaatcttctgcaatacacttcagggttgtgctgtgtgatcactaaactgctccaaagagtagagaaaattctcctgcctttgaaccacattgcgttagtttcattccttttgttccttatcctttccctttctcagcagattttgtaatttaaactattcttttaccccttggacagaatggaaagccaagtactcttttcatctgatttctagcctgactg

SEQ ID NO: 412108 - DNA, 448 bp, Homo sapiens
gaaacacaatagtctaagtagtctaaatactaaataaggtaaactgccagagagggaaaaagatgtgaaaaatacttaagaggccagcagtctttagaattagcatcccctcatcataccaattttaggttcacttgaaaaattcactaatggggttaaactgagggcttccaccggcgtgtcaccagcatttagtctctatatagaatccagctacagtccagcacacacttgattggtgatcagtaccttcacaaaatctaccttctaatgtaacagcacagcaagaattgagatccagaacaatcttacagatcaaatgaatttcaaaagtgtaaagtgactgtatttgattgcccctttttactactctttactggcttaagtttttacatgaactagatacaagccctcttactatgccatattctctttcatatgccaatga

SEQ ID NO: 412109 - DNA, 408 bp, Homo sapiens
ctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaac

SEQ ID NO: 412110 - DNA, 467 bp, Homo sapiens
ttggtgtgcacctgcaatcccagctactcaggaggctgagacaggagaatcacttgagcccaagaggcacaggttgcagtgagtcaagatcatgccactgcactccagcctgggtgacagagcaaggctctgtctcaaaaaaaaaaaaaaaaaaaaaaaaaggctgctctaaaatggaccattttatcagttttctttttcaccttagagatttttttcagtggaaaggtgtgttaggaatcatagattaggttctatataaacaattgaggaacttttatggtttttcaatatcataggaagatgacaaaatgagttgttctgaggattaaatgagttaatagattttaagcagttagaacaatgccttactctatcaaacatcatgcaatgtttgatatttaaaaggacattccttatgatgagacaattttcttttcctcctccccctccgccttctcccattt

SEQ ID NO: 412111 - DNA, 3642 bp, Homo sapiens
caaggtgggggattgccagggggagaaaacttatttattgctgtaagacaggacccctcctcccaacctcataccccaccgcacaccagagctaaattcaaagctgaaaggcgcacgtttctatacctacattcattcctgagggaccctccagagggtcaaggtcccagccccaggcagccctgtcacagtgagaagtagttcctgtccttaaggaatttccttctaatccaggtgcttgggcaggaacccgatggccttcgggtcaccaaggctgtctgggagggaggcacagggccgccctctgtgctgaggccgtggaggaagccaggaggagggtggcttgctttgcttccttgtctaattagcttgcttgaagatgtggccttggcagggagccagacccatggggccaaggaagaggaagagcatcctcaatagactcactcccccttccttggtctccacgggccccgtggactgagggctgcattggggtcttctgcctaggggaagtgctggacctgagctggagccacttggcttagaagccacaggattcacttttcactggcctttgcagtccccaaaggatcaggtctcagaaccaaggctccaaaggctgaggtctccccagttcctcctctcagaactcccacagtagctcagaggccgggggtcctgccaactttcatttggaaagttctttcgaacatctaaactagatctatcttagggtttctttctctcctagataggatcagctcccagccctagccattaggctgctggtcctggcgggggatggggtcccctcgttacccagtccttcccagggacccaacttcctaacacaacctggcttggacatgaagaccctcccccaggttaccttgtaaagagtcctccagagctgggatcccatgggcgcagcagcacacccagctcccatggcgtcactccctagctctgtcccagcttttgctatcattgctgacttttcctcctgtggctcattctgtccctgccctttgaaaacctaaaataccaagggtgtcatgctggcaactccctgcccagtcctgcacaaagccttggctgtgtgtggcaccccttgcctcctaccccagagcagctggctccattggcttctccctgcaccagccctgtcctcaggggtcaggaaaaagcagcacagctttctttcctctcctccagaggcctggaagggaggtggaggtccagtaagggcctggctgccttggatttcttggtcctgccttgccaactgcaccctgtagctcctgctccctgtgaccccagaaccagaggtgctgccttccctgtctcctagacaaagcacaaagggatgccctgcttggcttgagcctgcccaactgaaggattttctctgccccagggaccttccatccctgaatacaaggctctaggcaacttctctctgggtggtacacactagaatgcctggcattagccctagaaaggaggttggggtgtatgggtagtgagctagggtgggagaaaggtggtgctgaaaggacagatgctagttgtagtttcactcactcattcattcattagtgcaacagtactgagcaccacctgcactagaggcagaggggtgaacaagatacccttctgcctggggggatgtccacttcccatgggtttggctatttccaggaaagcccctcagtcctccaccctgttctggctgtgtgtgaaggatgtgtgtgagcaggcccaatcctttgcagcaagaatgagaggtcagagtattccattgcacacgcaccctggggctgacagacttgtgccccctagccttcatgcatgcccaagcactggcagctttgcagcccctgccccaccagccccttgacgctcttcttttgttctctcctcggggatgagctctgctgctgagtagggagcttttgcttgctgggaggctctatgcatggatttttttggtgaccatacagctagggctgaggatgggaacagggacagagggcctggctatccctagaagcacttcatccatctttacccacccaaacgggatcccttcacatctcatacccagtaagatgcaagaaaggaatatctgagagcaagcagccctgctccaggggccccaggtatgtgtagaggcccagtgggggtggccacttggtgtttctaccaccccctgccatccagtctggccccagtacctacctgggaggttggtgtacttggcttaagtacttcatgctttattcaggctgcttccccacagcaccggcaggaaatgaaggtgcacttatatgcatccctgcaggaataaagagtgggtggcctgcccagcccagcaccacggcctttccccagccaggagagaccacctaaggatcaaggcagctcctgttttcttggttctgtgacactcgagtctgagccagccctcaggaattgcctcaaaagagaaaaacaaaaaaaagtcctccttcccaaggcctgctactccaaggtttggctccatcccttgcctttgggtcctgcctatttccccactcctggtctcttatctttggggccaccagtggggagtcacccgggccccaatccctctaaggcgctaagttgaaggaggccttcccagagtgactattggtgccaaagtcccagttcctgttggacttggggtaaaaacaggagatggtgagtgggtgtaaggcccaaatgcccagagaagttaactcgaacccatgggacctgtcccagcctgtcagtccctgatgagtgtaacttccttcccctgggggcctggcccttctctccaacccagtggccatgctttctcacccagccttgtgcccggcctgcatttctgtatatattgctgtgtattgtgtgtatgtatgtattcctggacaagtgtgttcatctgcagcccttgcctgaggataaggtttaggattgggtaaagatcagaataccagggccagctaaggcaacgactccctccccaaacccttgggacctcagccagtcccaaggctgccctgacaatcaggcaggctccccaccgtgaggccaagcctcctctgccactgccagcatggcccaagggaggcttggccttgggcttgccagcctcagctctgccctgacaagggtcttgtatccagggcagaggcctgaggtgacccaggcttgctttgtggctgatgccagcaggcttggttctagtgggcaccactggtgggcaacctccataactggcccttaggccctaccttcctacacagctaggctataatgggcctgagtgagagggtagcttccccagccccaagcacaggcagaggggtggagagcaatttttggttttatttttgtttctgaagtggtgcctgtacctccagcccccagggggccttccctggccacacttctctgccccacccaggcatcgccatcccagcactttgctccatgtcacccgtaagatgccctttgctgaatgtacctgagtgtatgtatttaaaaggactcacatgggcatcagagaatttatggctctgtatccaataaaaaagatggtgaaactggtctatctgccagagaggtaaa

SEQ ID NO: 412112 - DNA, 709 bp, Homo sapiens
gggtcactcgtgatgcaaccccaagtgttggatgccactttaaatagctacttcaagcctacgccacagcagtgccaaggacagccaagtcaacccggtgcagctccagatgggtttgcttggttgcagcatccgtcactgcaaccaacctcaggatatttgcacaggagaggaagaaccctagccttcaagtcatcgttttagctttaatcaatatactatctagagctcaatttggaatactgaagggcagttgtcctatctgctgtcatctaagttaagttcttaaccaaatggattcttcaaatatagattttttaaaacactcacattttagtttgtatcttagaattgcatttgtatctggcaacattttgtataggaccatctaacttgtacattcatgtcagagcatgtagttttattcaggatttggttgaattaaaaaataaatcaatgacactctgaagaacagcaacagagtcatgctgtgataaattagatgtatttcattaatacaatggaaatttactttgggaaactagcagaggccctacataatatccctgtggtgaacaacctgttctatttcagtgcattttttagtttagaggcagaaaaacgttagtaggtaatcttactttctaaaaggtgataatttgccatactacagatggaatgaactatgtatgcagtgaaaatatgaaat

SEQ ID NO: 412113 - DNA, 399 bp, Homo sapiens
ctgttagccatcaacagcatcaaggccctctaccaacaaaaagataataattcactgaaggctcagatgattgttagcagtttttagcaataaagtctttttaaattaaggtaagtacactatttttatagacataatgctatttgcatatttaatagactacagtagtgtaaacataacttttatatgcagtgggaaaccataaaattcatgtgacttgcttaatatggtatttgctttattgcagtggtctgcaactaaacctgtaatatctctgcaatgtctctgtgtgtgtgtgtgtatatatatatatacacagatatacatacatacatatatgagtgtatgtgtatatatgtgtgtatatatatacacatatatcacacacatatacatata

SEQ ID NO: 412114 - DNA, 740 bp, Homo sapiens
gttgagccaggtgcgtttctaacagccctgctgaaagacagccaatggcgtaagacttttcttttttcacataaaaacccactaagcttcccgcagacatcaggcctttcacctgactcagggcccgcggttatacctgtgtagacctacgttagcaaacagcggcttatcggaactcgggccctctgacatcagccaggaaggagcaggctatgctgctgggaagtgcaggcctgaaaggctgtttttcttactgagtgagcagtaaggtcacccagataacccactcctgagtcacgaggcctttctgacctatgactctggagggcagctctgtttatttcttctttgtggtgacaatgtgggtgtcaccttgaggagcccattgaagaagttcattgagtgagaagactcggccgggtctccggggccgctgtaacagactcagggctgcagtaacagactcaggccaccgtagcagacttggggcctctgacgacagaaatgtatttcctcgccgtctggaagctgggaggacctggttcaaggtgcgggcagggctgctttcccctgagcctctccacagtgtcttccaccaggggcttcacgtggtcttccctctgtgtgcgtctgtgttctaatcacctcttcttgtagggacacgagtcatgggaccttttttaatcataatcacctctttaaagatcctgtctccaaatacagtcccattctgaggtact

SEQ ID NO: 412115 - DNA, 149 bp, Homo sapiens
agaattaaggtgtgttagaaattcactatcctgggtaaactgataaagcactaaatcacgttgagggactagtctctttatagcaaatttaaatttgatatccttactaataatgaatgatttagctaaattaaaaataaattgtaaga

SEQ ID NO: 412116 - DNA, 705 bp, Homo sapiens
ggtatgtaaatgaaaaaagtatctagctcctaactgctttgtcaggcccacagcctcttatctaaaactcttggagccagatgtgtcttagaaattaagattacagattacagaagggtacctgtactttgtaatgtataacacctagttattggggcactaccccaaaagcaaacttatatttctgtggcaaaatgatagactgtttacactagtaggatagggttacaattcaggtagtattgccaccaaataagtttgctccaagattaccaaaaaaaaaaaaacagaaaacaaaacttgttttttaaggcatttagatttcagaatctcagataaggggtcgtagacttgtatatcagtttggaatgctttcattgcacgtaacaaaaaacacatcccagtgccttaaacataagggcttttagtgtttactaaaccagttgtcaaaggtctcaaatttgataggtccttgtcgtcaaacctatgattttatataattccgtcctcccttccttaatgtgcagcctttcttcatcatgtctgtcaccttatagtcacaagatggctgcagcatctccagcttctcattattacatcggtcttataaagagggaggaaagagaaaggataaaaaggctttctcttagagaagccctgtcttatattgagaaggaagctctccatcatgcttccccttatgta

SEQ ID NO: 412117 - DNA, 449 bp, Homo sapiens
ccacatggccacatgcgcacacagccatatgacgtcatctacagccctggatctcaccagcccaggaacccccacatgcagaccagagtccccatggtgaacggaacaggtctccctcacgccgcacacagacccagatgcacagccacacagaaaccccagtcccacgtgcgctgccacaggcacaggcccctgccagagcccggcagcagatacctggggaggcggcgagggtgccgtggggtcgctaagcctgggtgcctggccccttggccctccccaacagccagtcttccccaaagggccggatggttcttaggacgggaacgatggtgtcactgccttccgggccattgcgccataggccccttccgaccacgtggctgccggtgccccgttgggggtggtggtgagcggtaactgtacccgcccccaacaccttctgacag

SEQ ID NO: 412118 - DNA, 641 bp, Homo sapiens
tagtggtacatgataatgataaatgtttataattaatgccatcataaattcaataaattaaaggtagagcttcttcaaaagtcgtcatgcatatttgcatatcaaaagattcaagaaattctgttgaaaagacaccaatttaggattagaaaattaagagtttaggattcatagtctaaccaacatcattatccttctatcaataagccaccatactgttcagaatattaatttgaaaaacctcgtgtaacatttgcttgctattatttgatttacaagcttatttctgaaatgttatcttgtttatagcaggtaatgtctgctccaattttacaaacaatgcaaaggggaaaaaactccatcttctgaacagaatcctggcatattccataaagatacatagcacacagcatggattgttgtacataaacgctgttcagttattgggggctgcctttgcaggcctcttgcagaattcctagtcaacagatccctgcctcactctcctgaccccatgcacatgttcacctgtcttagctggtcctgcttggcccctgtgatttttccctaacccctcctataagaaaaacattcaccctcaatttctggttaaaccctgtaaatgttggttataggtagct

SEQ ID NO: 412119 - DNA, 666 bp, Homo sapiens
agactttcaaaaaaacagaaaaatccttgacattctactctccttcttaaaataccatttatttagatgttcataaatgctttacctgaatagaaaaaagggcaaagggcagctgtcaacaaagttctttttgtgagcaagaaacaaagaaaaaaaaatgaagtctaatgtgcaaatgtaaatcatctaaccattgtaaatcatctggattaatattaccattaaatattttcaaaatatgtttgtcacttattttatgaccaaatcttaaaaacgcagatagctttttgccttctgcacctccctggttgtaggagaatcgttgttttactctacagggctgctctttcctaatgcaacatccccatctggtgaaaataggtctttgcaatcaaggctccatgaggtaggagccattagttgaatttgtgcataaataaagccattctagaataaaagatcacaataacactattttaaagtatattttgaaagcacttgctttagactcaaagacaaaaatcacatcaaagttgttggtgctgtagctttgtaggagggggctagggaaggttcagggaagagaaggatgaatgctgaaggccatttctagtaaaattaggactagctacatttaaaatttatttcaattccccatctgttggc

SEQ ID NO: 412120 - DNA, 362 bp, Homo sapiens
caagtggctttgatgacatacttatgaattcatgaaagtgtttttcataatctgctcacctttggtgcttagaggttacgccgattgcttttatttgcttggctggaaaagaagagctctgagtgggatgcagatacataacacttcaaaacagttccttacattgtcttagctacttttcagaaacttgctggaactctctacccaaacttcaggcaatgataagaataagtgtcaaatattattagttctggagtataactactaatttttgtttcaactgcatagtacgtataaaaaccttggaatatttccagttatcttcactgtcatttagtccttaaaacccagaacagacattt

SEQ ID NO: 412121 - DNA, 411 bp, Homo sapiens
caaacaaccatgtggatgctgtctttggcaatctgccatttctctagcacattcataaaacaattggaatggcagtacctgggtgctgttcccagagaggcatataatgtggaacagctgctcttctattgaaatcattatggagtgtcagcctgagatatgagtgggcactggtttaaggatcactgatgaataatgactaagtgggttttcaaagaagcaacttgaggttccccctctctgtctggcatttttgcacaggagctgcctgctgggaagctcaagaagaatcttaaatgtcatttagaaaaactgtcatgtcaactttggcacggaggtatcatggtttctaaggagtatggcttatagaatatgtataattggaaatagagaaattagaaatttccatag

SEQ ID NO: 412122 - DNA, 657 bp, Homo sapiens
tatttgaaaacatgtacttacggaaagatcatttgaatgagagctctgagttttagacccacatacagtactagctagttgtgataactacattaagtcaattcacctttctgaactttagtttcattattgggataaaataaagggttttctttgatcatcagttttcttaaatttacaactaattcttaccttacaactttagttgacttaacatagttatctttcctctttagattttctttcttaacagtccttggacacccaatacttttcccgtgaatcatccatccaatcatttgataaacactaattgagcacctattatgtttcaagcactgcatgagatgctaaggtcacaacagtggaaaaaaataagtggcccttctgcagcttgtagtctagtgggagaaaaaaagattaatgaaaaaaatcagactatttaatgtgaaattacaaatgtgatgcatgctgcaattagagaagagtgtggtcgcatgataatgaatacagagaaattttcaaaaaagaaaggtaattgctaaggcaagtgttaaccagtgatgtgtctgatggatgtgtctgtgttgatatttctgacaaagagcaaataggagcaaggtgtgcaaatagattagagatcaggtaggagtcttg

SEQ ID NO: 412123 - DNA, 758 bp, Homo sapiens
gggaatgcttaagaggtgactcctggcggcagcaggccatagtgaatgaggtgtttcccaatggctagccgtagaatcgccagagaatgattgactacatttagcagaggaaacttcatattctagcaccatcaacatagtatagcaaaggggcggccccacctttcctttccctttcttacttctagaccttcccaaagactgttcctgtttcttcagagacccgcaggatttgttctccccacacaggctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412124 - DNA, 388 bp, Homo sapiens
gagagaatcataagcttgatatggtgattgccatgtgttcccttcctcttttcccacagatgggttgacttgtttgttccaaagttttccatttctgccacatatgaccttggagccacacttttgaagatgggcattcagcatgcctattctgaaaatgctgatttttctggactcacagaggacaatggtctgaaactttccaatgtaagttgataaactagagttcttaaatgtatgaactgggaagagcaattagggagtcaattgattcaactttcttattttaccaattaggcaatctggatgcctagaggaggcggtgtgactcctcctaagctaggaatcactccagagtccattccccattactcccaaataagtaatt

SEQ ID NO: 412125 - DNA, 1545 bp, Homo sapiens
  misc_feature (4)..(4): n is a, c, g, or t
agangcaggtggattcttgggcatttgctattaacttccttccatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412126 - DNA, 1606 bp, Homo sapiens
  misc_feature (4)..(4): n is a, c, g, or t
agangcaggtggattcttgggcatttgctattaacttccttccatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaataccttcccaaagactgttcctgtttcttcagagacccgcaggatttgttctccccacacaggctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412127 - DNA, 1575 bp, Homo sapiens
  misc_feature (4)..(4): n is a, c, g, or t
agangcaggtggattcttgggcatttgctattaacttccttccatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatagacccgcaggatttgttctccccacacaggctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412128 - DNA, 1883 bp, Homo sapiens
ttcagaaaaaaagtgattcaatttccataaatttaatttactcacagcgttttcataatgttgctataacatctgaatgacagtccatggcatattcctggttgcagcaagcactctcctactccctgtccatattagatgcatctcctgttttcaagggagagaaacccctgctcagcccctgatgagcacatcatcaaatatttactattgttttattaatcaatgtgggtggttattatgtgtctctggctcagggagtgtttcatccaactaagctccctcagtggttgtctcacttcatctcttatagattaacttccttccaaaatgtcaccattcctgtatctggttctcttggtacttgggcttcatgctaccatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412129 - DNA, 1612 bp, Homo sapiens
  misc_feature (4)..(4): n is a, c, g, or t
agangcaggtggattcttgggcatttgctattaacttccttcattaacttccttccaaaatgtcaccattcctgtatctggttctcttggtacttgggcttcatgctaccatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaaaacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcc

SEQ ID NO: 412130 - DNA, 344 bp, Homo sapiens
aactcttaatacattagaaaaaaaatgaaatcccttttaaaaagcactagaggaaattctgtgtttaaagatttacttatttggcaatgcaaacaactgtttatttcctaacataacttttgcaaatctgaatttttatgaaaagatttttaaattaaaaattttaaattgtactaatttttactttttaagtaattttgagtaggtaatatttttataaagatatttgtatggtttgaagataagccagtcctccccacttctgcatacatatttcagacaggtatttcttggaagaaagaacatatgctgtgaaacttacatgtctcagtaggtctcatttt

SEQ ID NO: 412131 - DNA, 603 bp, Homo sapiens
aagttcgagtgacagaaaacctcaaatgtatagaatgaacattctcttagtagagtgggaattgaagtctcaaagtaacatataaacttaaaaatcttttggattcagatcctttgatctgtggtttgactggcagtcacccaaaccaccctgccctttcagttgaggctgcacccatatgctcagcatataatttcttttacttctggaggaggtgttatgatggatgcctgaccctcagtgactgtcttaatcaaggatcctctggctgcaaagagtagaaacatattcaaattagataaggcagaaagagggttgattatcaagttccaaggatatttcatggaaccaaacacaggaaatatgtcaggacctcatgaagaactgtacctgggaaccaagatgataattattggtttgaacacatggaagacattaactagcatctctaattctcaattctaaattcccaggagagactgtttgatgtagcttgagccaagtgtgtgtagctggtctggtccagatcaagagggctgggttattcagtccaaatgtggctgcaggggcccctcctgggggtgaaggggctgctcacagaga

SEQ ID NO: 412132 - DNA, 628 bp, Homo sapiens
taccataaatagtctaagagttaccattaatcggaatatattttaaggtttcctgggtgtatttctccccaaattatttttctctgctaaggcaaaaggaaataagtaacatatttacttataaacagtaagacatttccaaataggtagtactcatttgctggaataattaatcttctcacagaaaccccaaaatagtaactgttaatgtataaatgtttcttttaagtacaattaggtaactctcctttactgaaacccttgatttctaacaatttcagtacggttatttatattaaaacatcaatccaacaactcatagtggctctgtccattagactggcttgagaggagagaccctgacttaaccacttgcacaaacccaacacttggtacaattgccacacagtagtcattaaaccaacctgaatcacaaagagctgcagtagttatttttcctattcctaaatggtgtcttacttcttttttcactgattttacagattaaaagcaagcaaacaaacaaggcttactcaagtgtttaccagatttctgacttagcccctcaggaactgtgtaatattgggtagatgatttaacctctctgtgtctcagtttcctcttctgt

SEQ ID NO: 412133 - DNA, 618 bp, Homo sapiens
tgtgtgtgtgtgtgtgtgtgtgtgtgtgtgtgtgtgtgtgtgacagggtcttactctatcacccaggctggagtgcagtggcaggatcatggctcactgcagcctcaacttcctaggttcaagctatcctctcccctcagccacctgaaactagggtctcgctatgttgcccaggctgatcttgaactcctggcctcaagcaatcctcctgcctcaacctactgaagtgctggggttagagatgtgagccattgtgtcaggctcttacacctttgttaaatatttagcggtgctttcctggccacgtaccctctttttccaactgcccatgtacctagtcttctctgccctctggcttctcttctcttaaccccttctttttcacactgttggtcactgccttattcttgagatattttacatcctgggcttgcaagacacctgatttcctgcctacttccaacttctctgactcatactttctcaaactcctaaataaaagtattttctagaattctgtagtcttccttatatctcattttagtgtatctccagcatgacttcaaccacttgcatggtttcacattctttttttttttttttctcttgagacggagt

SEQ ID NO: 412134 - DNA, 685 bp, Homo sapiens
tcagcctcccaagtgctaggattacaggcgtgagccaccactcccagcttattttaattttttttttaagacagagtctcactctgtcatccaggctggagtgcagtggcacaatcaaggctcactgtagccttgacctcctgggctcaggtgatccatctcagcctcctgagtagctgggactacaggcacacgcctccacacccagctaattatttttttttttttcttttttggagatggggtctcactatgttgcccaggctggtcttgaactcctgggctcaagcagtcatcctgcctcagcctcccaaagtgctaggattgcagatgtgagctaccatgcctaggctgctttaattcattattttttattttcatgtttttaaataatattattatcttgatttttcttgacttttcagtcttacatattgtctgttgacttccaagaggaaagctgtgttaactccgctaagaattgtacaaaatacgcttaaagtagaaaggaggtcacatcctttatataggttagctcatttaccattctctgaaggtagtagactggtactcccttgttttatagacaaagaaactaaaattcagacaagttaaattacctccacatgctcacacagctctgtcatgttctagtgcatcaaactctagtctgagtccaaagccc

SEQ ID NO: 412135 - DNA, 411 bp, Homo sapiens
atagtacagcttttcatactgtcagccagagccaaaatagaaaatcatttttgtttgtcacatctggtatcttatcttcaccaactctgggtaacttgacctcctaaatttctatgaaacccacccctatcctacttctctaaatccagtctattgcttttattaaggtcttcaattgatttataactgatctcctcatatctggacactggttgctgcccattccagtccatcttcattgccagcaggatacaactcctaaaatgcacatctgaccttgccctcctgcttgacattttccatgattcaccatcaacaaagtttatcaagtctacctttttagcattatacagtcaacacatacttaaatatgtgggaaacacatcatcctatatggtttaaaagtgagct

SEQ ID NO: 412136 - DNA, 677 bp, Homo sapiens
gagggagggtgacatttctctttcatattgcccctcgatttcaaaggaaggttgcagagggaagaaatgcagataaggaatactgcgcttactgataccggaatgaagactgagtaacatcaatcccaaaaggatgctctcttttcatatgatctgttttccgttcaaaaatccatggtttgaccttttaatgcttatttgttcctttacaatttttaatactcagttgagcatagaacaggatgggtagagacagtgcaaaaatggaaggagtaggttggagagtacacttgcacatcactcagaatgctccctgcttggggcctgagaatctgatcccaactctatatctaacagatggacaaaagcttcgaaataatatctgaatggtgatggaggtgggacactatagaaatttctgaagctttcatgcaaacaaatattggaagtaaaaggatcattatgaaagggccagataacttccctagagcaagatttgtagcactggacattctgaaaggtaaaagctctgaaccttgccaatctaggcacctttgcatataactgaaactgagaggtatgtcatatcctacccccaggcggaaagggctggggacagatgaaaatgcttagctacaacctgtctttgagataattgcatgttccaaacaacatca

SEQ ID NO: 412137 - DNA, 235 bp, Homo sapiens
tcttctgttgttttctaactagggcaatatgctacctctatccatttcgtttgtgtagcaagcactctgttgatgcccagttcatataaaaattcatgtctagaaccttaagaacaacctaccaagaaagcagcatctaacagatttctttgctgatagtgatgaggaatttatctatgagactgatgcacaaaatgaacttaaatgtggagctattactcacttcaattcacgg

SEQ ID NO: 412138 - DNA, 704 bp, Homo sapiens
gggagagctactttcagtggtacctagagaggtagcaaaaagggggaagactgcctcacctccttacaggaggccaacaaacaacttagagatactaactgataactctctagtgctttatctctcttaaagaaatcttcagaattgcttacatcccccttggttcttcccccacctccaggtacatccccagcttactccgacctctctgaacttcctggaccagatctgtttcctctgcctgcatgctctagcctaccatcttcctctccttgtctgctactcactcaacagaaggcaacagggtggtctacttctacaactccgtctcctgatgatttcacaacagtctccctggcagcctttcatctggaagaagtggaaaagggggaacctgtaggaacatctctcatgatcacaccatatagggaatgaccagtaacagctgccaatcagattaatcaaacatggaaaaaaaagatgaggttgcaattgggggaataggatgcaattttccaggaggtaagagtgataaagcaacaataatcttatcctacataatgcctacgttactaaaacaacccttgtggtaagttgtcatttatttattatttatttatttatttattatttatttatttattttaaggtggatactcactctgtcactccagcctagttgacagaaagagactctgcctcac

SEQ ID NO: 412139 - DNA, 179 bp, Homo sapiens
gactgagcctgccttttgattggtcaatgttgcttttcccttggtgggagatgaacaagaaaacagactggggactcaaaacacaccaggtgtttaataggtggctaagtgaataggctttccaaattacatgccaacacagcagcttgccacagctttcagcccactgcttgcactat

SEQ ID NO: 412140 - DNA, 906 bp, Homo sapiens
agcattgcctgggggatcagagccggcagtgtctgaagtatgctctgcacagtgttccaaaaagacctctcacctaaattgtttgccgcctgagtttagaccccattcactaatattgtcaaaaggggattgattgtatcagttaagtctaaccattcttcaaccctggccacacctttcttcctctactgtttcagaacaaggtacagtaggttttccttcacataaatgaaatcacaatcatgtgaatgctgtgaatgctggattaggctgaaatgctagaagaaacaaaagtgagacaaatgtgaagatctgtgtccatttctcagcagcacgtatcaattgcatcgtggttagagaatgtatccagagggtgaagcatgatgctttatttggaaagcatttaaggacatgaaacgttatctctagaggggagtaaatcaaggcaaacgtggaatttagtatagctcctaccctagattaaaactcctgcctagggccgggtatggtgactcacacctgtaatcccagcactctggggggggcgaggcaggcagatcacaatgtcaagagatctagaccatcctggccgacatggtgaaaccccatctctactaaaaatacaaaaaaattagccagtcatggtggcacatgcttgtagtcccatagctgcaattacaggcgagcatcaccacccctggctaatttttgtacatttagtagaaatggagtttcaccatgttgcccaggctggtcttgaactcctgacctcaggtgatccacccactttggcctcccaaagtgctaggattacaggtgtaagccaccgtgcctggccctgaaatactttaaaaaaaaattatgatgatagaaatattattgcaaatgtgcaattagggtaaattg

SEQ ID NO: 412141 - DNA, 564 bp, Homo sapiens
ccatactcaaaagaaaatttcaagaaaaaatgcaaatagaaaaacatttctgaaatgatttatcttttgcaagccaaacaccccccaccaaaaaaaaaaaaccagttgcatttgatcaaaaggatacttcaacattgtaatttaagagtaaaaatatatttagtgccttcatttacaataaatgtaattccttttttacattaaacacattaaataaatattctgatgattaacagaagtcacgttttagttctcaagaacaaaatccctctgaggctgggcgcggtggctcatgcctgtaatcccagtacttcaggagacccatgtggggagggtcgcttaagctcaggagtttgagaccagcctgggcaatgtagagagatctcatctatagaaaaaaataaaaagtaaaaaaattagtcaggtgtggtggtgcacactgtggtcccagccactggggtggctgagttgggagaactgcttgagcccaagaggtctaggctgcagtgagccatgatccccccactgcactccagcctgggcaacagagggagaccctgtctc

SEQ ID NO: 412142 - DNA, 316 bp, Homo sapiens
tgatcaaactgaaactcttgcatctcaacctatgagccgcactttattgttattttatttttttagagacagggtctagctttgttgccgaggctggcgtgcagtggcatgatcacagctcactgtagccttgaactccagggctcaagtgatcctcccacctcagcctccaagtagctcggactacaggcatgtgccactgcacccagctcaagagctacacttcaaagcacagaatgaaaacctatttttaaagccaacttgatacatagagtagcttaccaagaattagtaacaacaacaacaagaaaaaaaa

SEQ ID NO: 412143 - DNA, 1392 bp, Homo sapiens
cattaacagtgttggaataacagtaccagcactaccatgagctacagtcatctgccatgtaacaatattttggtcaatgatggtaaggttggttccgtaagattataataccatatttttactgtaccttttctatgtttagatatgtttagacacaaatatttaccactgtgttacattggtctgttgtattcagtacagtaacatgctgtgccagatttgtagcctaggtgtgtagtaggatataccatctaggtttgtgtaagtatactctattgtgtttgcagagggatgaaattgcctaatgttgcatttatcaggatatatcctggtcttaagggatgcatgactgtacgtggtttcgaattgtagcttgaggatttttttgtagttcttttatttttgtccctaaggtattttccactgggagtatttggttaaattgctgttttaaagttctttgaaataattgttctatgtctggttacgttatcagctggctacatagtaaggtttgtttgtttcattttgcttttggctttataaagattgcttttttaacttcataaagattgctttatttatagtgtaacatttaaaatacatatatgattgtgaaatatttacattgttccagaaccaaatctaccatcatattccctcctcaaccatttaaaaacaagtttatgacttttgttttaaaaattaaaggcaaatatatatatgcacacttgtgcctgtatatgtggctataattttttttccattctcttttactttgctcaggtagtacagtagctaatgcttcttgggtttggtctctacagacaatcattctttgtactcctctcagtgatagatttttactcaaaaatcttctcaaagaaaagtaaaatttgatgtccctcaacatttgggcctccatataacttttaaaccccatcctcaatacttctcctccatcttttctttttctttttgggacacagtctttctctgtagctcaggctgggagtgcagtggtgcggtcatggctgactgcagccacactctccccggattaagctatcttcctgcctcagcctcctgagtagctgagactacaggcatgtaccacgcctggctaattttttttaaatgtttagtaaaaatgaggtctcagtgtgttgcccaaggtggtcttgaactcctgagctcaagtgatgctcccacctcagcctcccaaattgctgagattacaggtgtgagataccgtgtatggccctccatcttttcttcttatttttatttcaagacccttaaatggcttcctttctctttttatgaagctttcccttaatcgtttagaggtagaaccaattcctctttgtgcttccagaataaaaaaaaaaa

SEQ ID NO: 412144 - DNA, 639 bp, Homo sapiens
attattataattgtagcttattcatggagaaaagtgtttctctcactttgatgatccttgagttgatcagatgtttctccagaaatgagtaacgatatccagaacatgttttgatcttctcagtctgcatacaggtcattacaaaaatgccatataaaaagcaagatctaataggaataaaacgtaataagttaaaactaacttgcattaaattttaaaataatgattctcacagtttataaaacaatgtgcctgggccttcaccttgaccctgtgggtttgggcggatatcattgttatcatctgtattttctagacaggaaactgagacagagaatgaatgtccaaaggtttaatatagcaagtatgtcacagggtcaggatatggaacaccagccttctgactttttagccaattctccccctttagcaacaaggattctctagctgtttgacctggagaaatgcctctggtgtcactcaaaggcatgtatagcatcccacttaagctgaatatatattctctaaaaaaaaaaacatactatacatgcggccgcaatttgagcttactttgccaatttggccctattgtgagccgtattaccaattaactggccgccggtttacacgtcgtgctgg

SEQ ID NO: 412145 - DNA, 373 bp, Homo sapiens
tatttactttttacactaatctagccccggttttgatgcctcccaggggatctctagttatagaagaagcttatttgtggatgggcacagtggctcatgcctgtaatcccagcactttgggaggccgaggtgggcgggtcacgaggtcaggagtttgagaccagcttggccaacatagtgaaaccctgtctctactaaaaatacaaaaaattagctgggcgtggcggcaggcacctgtaatcccagctacttgggaggctgaggcaggagaattgcttgaagccgggaggcggacattgcagtgagccgagattgcgccactgcactccagcccgggcgacagtgcaagactctgtctcaagaaaaaaaaaaa

SEQ ID NO: 412146 - DNA, 3356 bp, Homo sapiens
  misc_feature (2269)..(2269): n is a, c, g, or t
  misc_feature (2297)..(2297): n is a, c, g, or t
  misc_feature (2519)..(2519): n is a, c, g, or t
  misc_feature (2675)..(2675): n is a, c, g, or t
cgactggctggtcccctggccgtgagccggcttctgaatgatttatgccgccttgaacttgactccagcgtgacaggagtgagaagagccgctcccgctagaggaaagctggaaaccgtactgtgctcaccacataacctctgggtgctggaaatggagtattactactgccccagcctgctgaagctcttgcgctacctctgggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggcnacctctcaggagttcatttgtctctctntctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagancatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtngaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagatttttccctaatcgctcgggctctcccgagtcacgaacgttgtatgcgcggccatggat

SEQ ID NO: 412147 - DNA, 6150 bp, Homo sapiens
  misc_feature (2269)..(2269): n is a, c, g, or t
  misc_feature (2297)..(2297): n is a, c, g, or t
  misc_feature (2519)..(2519): n is a, c, g, or t
  misc_feature (2675)..(2675): n is a, c, g, or t
cgactggctggtcccctggccgtgagccggcttctgaatgatttatgccgccttgaacttgactccagcgtgacaggagtgagaagagccgctcccgctagaggaaagctggaaaccgtactgtgctcaccacataacctctgggtgctggaaatggagtattactactgccccagcctgctgaagctcttgcgctacctctgggaccagctgaagcagtgtttctcccggcagcccactgaacccaaggacactgacaccctcgtgcacgaagccggcagccagtatgggacgtggacagagcagtgccagagtggggagagcttggccactgagtccccagatagcagtgccacatcgacaaggaaacagccccccagcagccgtttgtcttctctgtcctcccaaacggagcccacctcggcaggggaccagtatgactgctccagggaccagcggagcaccagcgtggaccactccagcactgacctggaatccaccgatgggatggaggggccgcctccaccggacgcctgccctgaaaagagagtagatgacttctccttcattgatcaaacctcagtcctcgactcaagtgccctcaagacccgggtgcagctcagcaagagaagccgccgccgggcccccatctcccactccctccggcgcagccgatttagtgagtccgagagcagatcacctttggaggatgagactgacaacacgtggatgttcaaagactcaacggaggagaaatcacccaggaaggaggagtcggatgaggaggagacggcatccaaagctgagaggacccctgtcagccatcctcagaggatgcctgcgtttccaggcatggatccggcagtgctaaaggctcagctgcacaagaggccagaggtggacagtcctggcgagacccccagctgggcaccccaacccaagagccccaagtcccccttccagcctggggtgctgggcagtcgcgtgctgccttccagcatggacaaggatgagaggtcggatgaaccctctccccagtggctaaaggaattgaaatccaagaagaggcaaagtctttatgagaaccaagtttgaccaggcagggaacactgccacatctacgtaacagaagccttaaccatcagaacccgcagacgaggccgagctgctgccgtttcttcctgcacaacgcttacgtgcctgggcccttcccattggattgagaacgctatccagtgcccctgtcctcgccaggctctccctggatccagacgggaagacccaacctccaggagcactcgctcatctccccagacagcacttcaggctgggaaaggagccaggctgcccagaaacgtccatgtgggtggttttgctttttatgtaaaaatttgcatttctacctattttagacaccttcatcagctccaagaacatcagtgtgaggctggaattgtctccccaggttctgaaaaacacctgcatttgtgaaagcacctcctcacccgaccccggggcaggtctttttttggaaggacatttccaaggaagatcaaactgttcattttctgctgtagtctcggtgcagggtattaccgctgggttgaggttttctattctttttttttggtgagttccttcttccccttgaggaatcagcagttccaatttttaaacatactctccctgattatgtgtatttctctttctagtggggctgtgtgcatcgttggcctatgttattgtatgtcatttttgtttgctttagaaggcgataaagcaataattcagctaattttctttgaaacttgataggtatatatgtgtttacgttaaaggacaggaggaaagatgtgcgaataatttgttctgaagtatccagtcacctcaggttatcttatccctatccaagctgtttagaagttataattgtcactcttgtatttatttccatggcttcttttcatttgagctctggtttcggtagggtgacctttgccccttggccttaagggttcataaactgcagcccaagtggtggtgcctttgcttatgaatcatcagacctgccctagtaatctttttctccagagtcttctttgaacatgacgtgggctgctggcatggaggagttgttccaaactggcctcagaacagatgcatgaatgaagggtactttttgcttttgctcacctcattttccttcatctttcttgatgaatccattatttgcaaatgctgtcaaaacatgctttccttctccctggcnacctctcaggagttcatttgtctctctntctcagcttcctccctcatcttcctttacccctcttctctgtcttagtgggtggatgggcatggatagaaatcctctgtttctttaggttaggataaacacctgggccctggtgaggcagttgctgttcagcaccagggacagcaactgcagggctgtgaggccggagcccaccttgtgtcctgttcgatgagctttggttactgatgagcaattgccagancatgtcacccacccagccttttacacctgggagcctcatgcatctgggtttgggagtttggccctgctgatgatagtttgttttctcttcattccctgaattagtcatcagttctccgtggccatttggggattcatgcctgcaactgcttcagtngaattcttttttaaagatccagtttatgttttataataattttgatcttatggctttcaacgtcaataggatcccctttaaaaataccctgctagtgttttgttttgttttgtttttctgagacaaggtcttactctgttgctcaagctggagtggagtggcacgatcatagctcactaacacctgggctcaagtgattctcccacctcagcctcccaagtagctgggactacaggtgtatgctaccatgaccagctaatttttaaatatttttgtagagacaagggtcttaccatgttgcccaggctggtctcgaacttctgggctcaagcaattgtccctcctcagcctcccaaagtgctcggattacagacatgagccactgcacctggcctgaaacacattcctagtcttttgatcctgacttcttatctgggctgctgtctctctttccttcaggtggaaaggaccccttggtaccatctcaagcagtaggaaaggacctgctcttacatatattgatggtcctcatgcaaaactctcaattcttaattagtcatgtctcagctcaaggatatcagacaggaatgaaacacacttgaaaatgagattgacctggagattttttttccctaatctctcataccttaattggaaaaataatcaattaattctatgttaattaggatatacaaagttcaccctccttgaaagtgactagggcaagccctgaagatcttcctcacctccttttatttttctataaccttgtctcctccagcaccacagggaagacaatcacagtgggtcaagagcgaccctctttcacgtgggctctgccatgacctctgagacctgcttatgatcagtgcaatgaagttagaagtaactgatgattgggagcctttgcagatagctgggcaaatgggtgatttacttatccccattctaaatggagtgagctctctttgaggctaagcaaggaggcgttgtatgctagtttctagactttgcctggagacccctttggaaatctgtcttctttttaaactcacttaatatgccttaatcatctgtgtgtaatggagtcatccgctcctcaatctaaccctcctcccctggggctttggctgtcctcaatgagagtttcatgcagaatggaaaatcctctatatgtacaatctctctccccctcatttctcttcctcctcacctccaccacccctttgcacatcagcattttaacagctgatcttttgagaagcctgtatctttttcctcttcagtagatacccttcttcatggtcctttgcctaatcaaacagaggcctttggcctttgaaaatccatgacaaggcctcagaaatcagtgttgtggaggattactccatgccaccggagaaactctggtgaaagagaaacctcgtggtctttaggatgttgggattttgagtgaacctgacctgatagcctcaggattcagggaaaggacaatcagatggcggtgttttccagggggacgcgccaaatcatgtggtttcagacaattgtgtttgcctttgtgcctccctggaagggaggccaactaagggtatcaccaagaagccaaaagagaaataggcatgagcctgtggttttaaactttacaggctgggcaaaggatttagaaagacccttagcatgattttcctaaaagagaccttagctgctccaacctggtgctgatagctgctttgttgatctatgctttaaaatttttctttataatgcccccagatggctcctggaactagtcgtaattgcaaactgtaaaaatccctcctccccagtgtagatatttaaaccagagtaagtgatggggagacattctgtggtctctgaatgtgccttccccctcaccgtgtgttaaaacacaaaagccgaagttccatggcatcatgattccgaggggctggagggataggacccactccacatctaaaggggatctgctttgggctcggtcccattagcgagtgggggactcttgctgtgtgctaagaggctgctaggactcacccagttggaattctgggtgggctcaggaagtttagagccacgtaaaaagctggtaggcatgagtgtgccaggtctttgccagcctgcgtctccttttgcaccccccaatccagagtttgctttcttttgactaaattggctcctgcagggggaagggcagaaagctaggccctctgctctggaaagtcggcctgaggtttccggcaagttaacccttaaaatggacacccctcagcccgccctcccctttggccttcccagaatctccttcagtggttgctctcacacctgtgccataacatcatcttccatgacttggacgggcacttccttgacaattcctattggcatcacacgggctacaaattatgctgttttctaaagaatttgaacttttttttttttcttttcttgagacacggtcttgctctgttggccaggctggaatgcagtggcacaatcatagctcactccagcctccaactcctgggctcaagcaatcctctcatctccacctccagagtagcctagatgacaggcgcacatcaccacgcccagctgatcttttaaatctgttttgtagaaacaggatctcactatattgcccaagctggtcttaaacttggtctcaagtgattctactgcctcagcctcccaaagtgctgggattacaggcctgagccaccatgcccagctgaatttgagctttttaataatctcattccacatagccttatagatcctgtaaatagggggggtcacaaaagtaatatattgtgttatggaagataattttgtactgtgctgtttcctaaatcataccaatatcctaaagtcatgcacttcccagatgatcgtgatcctccaaatgctttgtaagatggggcagggcgtggaaatatatatatatacacacacacacagagacacacacacacacaagtatagtatatattttcctaacctttcttctgggtccttcctcagatctttgagtcacgatagaaaaggagctcgagttctttgtgtaggaaagttaagcttcctgcctgcggtgttcttgcaattgccttaggaattcacaagctctaggagttctgaacggaaggcagacgagaggcactttatccagtcccagaaagaatctctaaccgtgtgactgagaagtcatctagaaaaacttatatttttaatgtaaaaacaaatggggcttaccagacctcacagagtattggacgtctacaagtgcttttatattttgtaactgtaaagaagtttcatatgcacagaagagcagttggaaatctggtcgactgcaataaaacaagatgacctttgcatgtacaaagatgttgcattcagactatgaaaatagcaaataaagctttggtgcaagttgcattggaaaaaaaaaaaa

SEQ ID NO: 412148 - DNA, 800 bp, Homo sapiens
tagaggaaagctggaaaccgtactgtgctcaccacataacctctgggtgctggaaatggagtattactactgccccagcctgctgaagctcttgcgctacctctgggtgagtggcggggggcagtgcaggctccaggacggggtcacgtcctttccctctcctcctgcttcctgtcaactttgctttttggctgtgtctggttagcaatgtctctgttttctttaagaaatggtggaggttacaaggaagagagaatgttggggaaaaaggaaacgggcttggtttgggaggtagcacaggtttgtaggaagagctgagactcctgaacaggaatgaagatcctggatccgatgtgggctttcctccagtcctcaagaaaacaggaagaacgagaaccacttcagtgagtttttcagaaagcaacatttatttgatttaaaggactattctttattctgaaattacatccctcttgcctctgtgtgtgtaagaatgtctgtcttctatgggatgaaaataatagattttgctttccttttcctgaacctacacagtgatagaagaagttgggaccccttccccactaacactcacactgtgctgtctcctctggataacagaggaaaaaaaccagaacattttctgatgaaatgccaaagtcagggaagctgtgcagaagtgctttgtgaggtataaaatgctttcaggtctcactttgacttcgcaactggtctgttttctgtgcctgggcaagttacttctcctctctgggtttctgtttcctcctctgtgaaataag

SEQ ID NO: 412149 - DNA, 371 bp, Homo sapiens
tcacggaacctaccgacatgtgatgtctcccctggacgcccagctttaaaatttctctcttttgtactctgtccctttatttctcaagctggccgacgcttaaggaaaatagaaaagaacctacatgaatattggggcagattccccgataactagtgttcctttattaatgtgaatcatagacagccatcagtcttctattcatttttgtagttttgtgttaatttcattgttccctttaaaatatagctagctagtgaaaattacaaatatacacattgtattgaaatacaggtatattttatggtgataacaattatttcacaattttcttgatgaaaacaatatggtgaacattttaaactatttaa

SEQ ID NO: 412150 - DNA, 506 bp, Homo sapiens
accaaggttgccttagattttccagtacctgcaggtatcataattgaaggctgtgaaacagcaaacattgtagcctcctccttctggaagctccatcccaggggagtactaattcatttccagcctgaacatgcctgtaggaggtggccggagacccgaactgggaggcctcacccagtcaaggggaacagggtcagtaacctgcttaaaataagctgtctagctgggcctggtggctcatgcctgtaatcccggaactttgggaggctgaggtgggcagatcacctaaggtcaggcattctagaccagcctggacaacatggtgaaaacccatctctactaaaaatacaaaaattagccaggcatggtggcatgcgcctgtaatcccagctattcagtggaccgagacaggagaatcacttgaacctgggaggcggaggttgtggtgagccaaggtcacaacattgcactacagcctgggtgacagagtgagactctgtctccaa

SEQ ID NO: 412151 - DNA, 286 bp, Homo sapiens
cctaagtgatcctcccacctcagcctggctgagatgggaagattgctagctaccagcacacaccaccatgcctagctaattagaaattttttttttgtcaggagtttgagcccagcctggccaacatggtgaaaaccatcgctactaaaaacacaaaaattagctgaacatggtggcacacacctatagtaccagctacgtgggaggctgagacagaagaatggttgaatgccagagcgggaggttgtggtgagccgagatcatgccactgcactccagcctgggc

SEQ ID NO: 412152 - DNA, 507 bp, Homo sapiens
gaatgaatagttcttagtatttcatgacccgttaaaaggtattttattggtaagaaatggcagaaatttataaatatcattctggactactggaaaagatatacaggagatgctggggaatttttgatacccattgaaactgctgtctgcaaaaaattcaaacctgatgaaagtctcctgtgaattagaaagggctttctatacaagattgagataaaaaggattatataatgccatagtttgcaaactgctctgcagaagtatttcacagatcacatctggggcttctgttgattcaactttttatgttatatccatatgtgtctgtgtaataatttgtatgactaaagcatataccgccatacttcttaaaaatcagtagtataggactgggcgcagtgggtcacacctgtaatcctagcactctgggaggccaaggccagtggattgcctgagcttaggagtttgagaccagcctgggcaacatggtgaaaccccatctctact

SEQ ID NO: 412153 - DNA, 1236 bp, Homo sapiens
cacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctca

SEQ ID NO: 412154 - DNA, 795 bp, Homo sapiens
aatcgcggccgcgtcgacggagaagacgacagaagggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctca

SEQ ID NO: 412155 - DNA, 568 bp, Homo sapiens
cgtcatgatggagtcaaagatcacagggatgctggaagggcatcagctggaaagatcaggaggatgtagagtgctaagtctgaaacagagataaaagggtatgaacaggtaacagtaactcaaaggaatgggtggctgaggtagggcagagaacaggatcccaggaatagaggtcaaggaactaagaagccaaggtatcggaaggattagggtcactgtgttgttgtgttcaacctatgcagtcattcacagcggctctgggaagaatatcattaggcatactgaaataagaaaagacacagaaattatactagactacgtaacagaaaggtagaaactacctacttcccttctaggaaaccaagtcattcagacccctcccactacagaacaactggaaaaagtgaacaaaatattaacatctgtttgaaggaatcagaaaagtaacaactgggcacaatggctcatgcctgtaatctagcactttgaggggctgaggcaagaggattgcttgaagccaggagttcaagaccaacctggccaacatagtgagacactgtctctattt

SEQ ID NO: 412156 - DNA, 415 bp, Homo sapiens
cattgctgaaagaaattgaagaagacacacacaaatgaaaagctatccattgtctatggattggaagaattaatattgtttaaatgcctatactacccacatatacagatttaatacaatccttataaaaatttcaataacattttcatagaaataaaaaaatagttctaaaatttgtatgaaatcacaaaaggccataaataacccaataaattttgaggaaaaaagaataaagttgaagacatttcatttcctggtttcaaactacattatgaagtatagtaaacagtatggtactgatatgaaaacaggcacaaagaccagtagaacatagtagagagctcagacataaactcacacatacacagtcaactaatctttgacaagaatgccaagaatacacaatggggaaagc

SEQ ID NO: 412157 - DNA, 115 bp, Homo sapiens
gatcttattttccattcacatattctttgtccaaaggcagtttaaggaaactaacacattacattatgctataaatacttcagaacagtttgtccacattgacacttccatttcc

SEQ ID NO: 412158 - DNA, 599 bp, Homo sapiens
atggatccttttgtagttcatgagcgtgatgattgggtgttcatacgcttgtgtgagatgtgccacccttgaaccttgttacgacgtgggcacattacccgtctgacctgaacttcaaggatcgatttaacacttgtatttgtgggcttgttacttatgataacaggtggcctagtttcatggctttgtgtttaccgttttcgggtgcccttttttctggctgtatgctacacgcacgggtgcttttccgttgtccaactgtgtaatgtgtttttgtgtttgttcttttgtgagtcggagtctcgcgttgtcgccaggctggagttgcagtgttgcgatctcggctcactgcaacccccacctccggttttcgagagattgtcctacctcagcctcccgagtagctgggactataggcgcgcgccaccacgcccagctaatttttgtataaatattggcaaggatggtctcgatctcttgacctcgtgatgcgcccgcctcggcctcccaagggctgggattacaggcgtgagccaccgcgcctggccaatgcagagctttttaatggctttaattttttaggtttgggagatacctgc

SEQ ID NO: 412159 - DNA, 153 bp, Homo sapiens
gaaggaggctgaagaatgagtttagttagtgccttaaccgcgattggaccttaaggaccactaagaaagtagttgccaggcatcctgcgggaggctcaaggtagtcccatcctgcccgcccctccttgctctcttgtcctgggggacagtagc

SEQ ID NO: 412160 - DNA, 231 bp, Homo sapiens
attgaagttctctttctcactgtatgggggaacttccagaccccctcagtctcttgtccaagaccctctctcctgtgcacactacttggacgtgagttaacagaaacataggccgggcattggtggctcatgctttgtaatcccagcattttgggaggctgaggtgagaggatcgcttgagcccaggaattccagaccatcctggccaacatactgagaccttgtctctac

SEQ ID NO: 412161 - DNA, 424 bp, Homo sapiens
acagtaagccacttctagacccagtctgaagtcctgagcattcagctggtatctggagtggatcacctaagaaacattacagaacaatataggcctctggtatttaaaatagtttaattacgtcacagggtagtcctgaattctttcctacttcagccagtcttggccagccgagtttcagggtagtgatgagcactgatgaggtgactcccccttctccaaactcttcctttgccactgtcccaagaaaaccataaaggggaagtttaaatgatggatgtaattttcctgacttgggctgggcgcagtggctcacacctgtaattccagcactttgggaggctgcggtgcgcagatcacctgaggtcaggagttccagaccaggctggccaacatggtgaaacgctgcctctactaaaaatgc

SEQ ID NO: 412162 - DNA, 593 bp, Homo sapiens
aagaaatgttatgatcacgaaggtggtttttccagggcaaggcttagcaattttactctggatgtgctgacccctgtgatttccccaaatgagggaatctcgactacataatttgtggcagtggggaactgtttgtgctttcccctggattgctgtcgttttaaaagtggattttgtttgctgtggaagcatatacaacgcgttagtataaactaataaacaggtctttgttcccatctgtcacttactttcaaagtaaagattttgtcaggtagtggttggttctcacgcttgtaatctcagtagtctgtgagatgcattgataactttatgttaataccgctcgagctctggagtttgatgtcagtgtggtcaaatatggtggacccgtctctactaatctcttaacttttttttttgttctatagaaataaaactaagcttttcttttccctatgggagcccactgtaaacatttattaacagcaaacagttcactggagtgcatggcttactgcaacctctgcctcctgccttcaagctattctcctgcctcagccagagaatactcgatctcctaggtaactgagatt

SEQ ID NO: 412163 - DNA, 392 bp, Homo sapiens
ggaagaatagctaatggatgctgggcttaatacttaggtgatgggttgatctgtgcagcaaaccacatgacacatgtttacctatgtaacaaaactgcacatcctgcacatgtaccctggaacttaaaagctgaagaaaaaaaaaaaaaccctctcaaacccctgtatggaaggaaaacattaatagtcacatttatctcacttgtatttgtcagagatttgtgaattgccttaaaaaaattcatgaggctgggcgtggtggctcatgcctgtaatcccactacttgggaggctgaggcaagagaagcacttcaatctgggaggtggaggttgcagtgagccatgatcacgctactggactccaggtgagcaataaagtgagactctatctc

SEQ ID NO: 412164 - DNA, 490 bp, Homo sapiens
accctcttaagtggacaagctccagaacacaacatgaagctgatgatgacttaggcaatttatgcttgaactcattggcctcatctcaagtcagtgtctcagagacacaggtgggacctgatccccaaggaacagatagcattccagattcatgggagcaacttttgagatgtggagcacccggggggtcatttgaaacccatcaggttgccgggcgcggtggctcacgcctgtaatcccagcactttgggaggccgaggtgggtggatcacctgaggtagggagttcgagaccaaactgaccaacatggagaaaccccatctctattaaaaatacaaaattagtcgggcatggtggcgcatgcctgtaatcatagctactcggaaggctgaggtaggagaatcacttgaatctgggaggcagaggttgcggtgagtcgagatagcgccactgcactccagcatgggcaacaagaggaaaactccacctc

SEQ ID NO: 412165 - DNA, 555 bp, Homo sapiens
aactatggttatttagggtatccagtaaatattttctcaaaagtgaatgaagtgagctggtcacttcaaggacaacactgacagtatttgttgccaatgataaaatctgggcttttgagttagaattttggaaaacttgcatctactactattaactaatgagcttcccaatacttagacacttttccgatgagctcagtagtaatattattatatgtgattttaaaaatattgtacaataaaaggagtcaatatttgaaagactggcataacacagtgagccagtattttccagaaggccaatgcatggtaaaagatccatctgaagtataagatccacactttactgtgacagagtatgaagtttatatatatcacttcagattccacactaaaacctagctttaagccagatgcagtagcccattccctgtagtctcagctacttgggaggctggggcagtagaatggcgtgaacccgggaggcggagcttgcagtaagccaagatcgtgccaccgcactccagcctgggtgacagagcgaaactccatctc

SEQ ID NO: 412166 - DNA, 317 bp, Homo sapiens
ggggacgttggcagggtgcccctcatctcttcttttatacacatatcatgacctgggggacctcgagccagtgtgccttctccttcctcccctaagagatagccggattcccagcctagttcagccaagctagcctagagggggatcttggtgccttggttcctggcctagatctgacatgcttgtgataggaagggatgccaaattatttccctttacctccattgttctttcttcctgagtctaagtgccatttttcctgccctttaaaaaaaattataaaaatttattcctaggcagggtgtggtggctcacac

SEQ ID NO: 412167 - DNA, 398 bp, Homo sapiens
ttttttttttttgcatttagtagtgcattttatttattctaagttgcatacatttttacatttttaacatctgtgcaattgaaatggatctcacaactgatagactcttagattacagctggacacagaggctaacaccagtaatccagcactttgggaggccaaggccggtggatcacttgaggtcaggagttcaagaccagcctggccaacagggtgaaaccccatctctactaaaaatacaaaaataggtggtggcatgcacctgtaatcccagctacttgggaggctaaggcaggagaatcacttgaacccaggaggcagaggttgcagtgagctgagatggtgccactgcactacagcctgggcaacagagtgagactccatctcaataaatt

SEQ ID NO: 412168 - DNA, 663 bp, Homo sapiens
catacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgccttactggaagttgaaaggtagctgttattatgatcggcgctgggtctggatgtgtggtgttcaaaacacgggctgctgggcagttcgctttcgttttcacgtttttgtgggggtagggcgattgctgctttttttctcaccccgcgggggatcctttagtaacgcgccaattatactgtgggtttatgttctccagggtattgtcgtgaaaacgtcacgatctcgtgctttctccaggccaaagccgcgtttttcctgcaagtttggggtgtgtagaggaaaaagccagaactgctttctcttccctggggtatcccagggtcttggtaaccgctggcagaaacgacagaatacgtacggggcgggcaattaatcctggtccagggaagtatccggcttagaggtttaggaaggacctgtcggggttgagttccccacccagggggagatcgagtccgcgggagctgctgatcccacccaggcagctgctgggctt

SEQ ID NO: 412169 - DNA, 741 bp, Homo sapiens
ggctgcagtgacctgtgattgggccactgcactgcagcctgggtgagagtgagactgtctccagaaataaaaggcaacacatcacagttaatggctttatctaaaaccatgcttagacataaacttttttagcctttaatatatatttaaattacttagtaagacactgtgaacaacattttaccaataccaaaatttgaacacttagctgtgataccaaacattcagagtaatcgaaataatttgaatagaaaagttttatgtgtgaaaacatatataggaatacttattacaaccaaggttgtaatggtggaaaactggaaatgacccaaatgtctactatcaggaaaatgtatgaacacattgtgatgtgctgtatatgaaggtaatacatgtcacttaaaataagtgaactagggcgtggatggatcatgtaagtgtaatgctgaaagaacaaagcatattatagaagaactcaaagagtctagtgtcatttatgtacagtataaaaacatgcaaaataataccttatgtattttagttatatatatatattaagtaaaagcatgaagtactggatgggaatgatcagtgaattcaaggtggtggttacctctgggctgtaggcaggttccacaggcagcttctttaggttcgataatgtttttgttgctttaggtatgtttggtacagatggttctgttatttttatacctttctgcctgtcaaatatttcataat

SEQ ID NO: 412170 - DNA, 499 bp, Homo sapiens
gcctcaggagcaagcagggctcccttggctgcctctgctgctgtcacgccagcccaaggctcctgccccagggaggttactgttactgctgtagttgccaccacctgttgctcctgagtggatgctaggcccttccagggcagccagttacagtcagttttccatttccctggtgctcaggaaggattaggagaggtggtctcatggcctgaacagcccatgaaaggcagaactgagagactggggaggaagtgaaagtcctcccagctcagaaggaaaatgcagagaagtagaaatacccagcccctctcccacacccacacagactcagcccacaaactggagagtaaaaataaagaaatcgtacaggaagcatggagcaaatgactgtgagatgtttcgctttagagaagtgaggagcagagggggagcagaggctggagttggctgagaggggaaatccgcaggtacagcctgcggggctcttagagcccagagg

SEQ ID NO: 412171 - DNA, 223 bp, Homo sapiens
gagggagtgggaggaagaaatggaacccactgcagccaggacacgtgtcccttgaactgaagacagcagaggcacgcatccccttggagagactgtcatggaagagggtggagccgccgcccgaagcgccgaggaggctgagccactcagcatctcctggtcctgcagtgttgctgtaaatccccattggagactgcattagggaattaaagctgcttgtcac

SEQ ID NO: 412172 - DNA, 450 bp, Homo sapiens
aaatcagcatgttacaaggaagaaaagaggttgactgctcaaagggtaatctcagtttctgatcccagaaggcaaatgaagtgtgtggtctgtttgcagtctctttagaagcagacttttccccccatgaaggttcttttgcatgatattcttagaagcagaaaaatgggctgtgcctggtggctcacgcctgtaatcccagcactttgggaggccaaggcgggtggatcacttgaggtcagcagctcgagaccagcctgaccaacctggtgaaaccccgtctctacaaaaaatacaaaattagccggacgtggtggtgcacgcctgtaatcccagctactcgggaggctgaggcagaagaattgcttgaacctgagaggcggaggttacagtgagccgagattgcgccattgcactccagcatgggcaagaagagcaaaactctgtctc

SEQ ID NO: 412173 - DNA, 257 bp, Homo sapiens
agaggtttatgggaaccacagaaaagcacaggggagtgtggccatgaggagaccagggctctgctgtgtgactttaactgttgtggccctcaattctattaaaaggggggtaaaaatatctgctcttattaggaaaaatggctaatgcatgctgggcttaatacctaggtgatgggttgataggtgcagccaaccaccattgtacacatttacctatgtaacaaacctacacatcctgcacatgtaccccagatctt

SEQ ID NO: 412174 - DNA, 446 bp, Homo sapiens
cgtgagcacggctggcctggagggctgacagtcatgggtggctctggggaattggcggctcttctgcaacagaaccagcaaacttggtctcattaatacaaagccctgagttaaccctctagccagaggtgtttctcataaagtcactttgcgtctgattcatctcttggctgggttggaaggtaaacttctcggcatagagtccccagaggccttttgtaatcacaaaagagaaatgtgacagcctgaactgggtcgagaggtcatggtgaaagaaaggctggtgtcatcagctcagcactgacagatgccctcccctagaggagagcgcaggcacaactagttttgcctccctggattagctgtgcttacattttttttttcaccctcttctcataattgcataaaggagagtccccagaaatgtcacctcaagcccctttgca

SEQ ID NO: 412175 - DNA, 419 bp, Homo sapiens
gagttatcagaggtaatttggcttggactatggagtttattgaaactgcagatcttaacaatttcattattggcttatctagcatgaaaatctggcaaagtatttccttggtattcaattaattcttgtcttgcttggattagcagttttataaaccagtcagtctcttcattagaattctgggaattcttacccagcgcaaatgatgtcagggtcctttctatcctttccatgaacgttttaggagacacaatactttagcaatttacttgcttctgaagagctttcagaaaatgcatcagggctgggcacggtggctcacacctgtaatcccagcgctttgggaggctgagatgggtggatctcttgaacccaggagttcaagatcagcctgggcaacatagtgagacctcgtctct

SEQ ID NO: 412176 - DNA, 415 bp, Homo sapiens
ttcctagagaaagcattcttggagcagacacttctagactcccctcacttcaattccatttttctaagttgattcaaaaaggagtaccaaaaaattgtaagctcatatttacaaaattgattgttggaggcttgcttagagatgcataatcataccctgcctctcttctgggcttcttacaaattgaaaacaggcacagggagccggatgagtatcatggtcagtatctaccttattaatgggccggatgattcccaggtgtggatctagagtgagtttggaatatatttataacacttaaaacatcaaatgatttgtaggcataatatataaagaagtaatattagtgcaaaccggtaaaaaccatcaattaaactacaataaagttcactgcagcattctttattcaacagcc

SEQ ID NO: 412177 - DNA, 459 bp, Homo sapiens
cgctgccctttgtggccgaagtccccatcagttactacttttggtgctggtaattggctgggatctgttcaatctttacatgtcatctaaaacacactcatattatctggtagctaaacacttatatttcacagatgctataatgtagtgggtaaaatctctggatctaaacctcatttcagatccccagtctgaacttcccaactctgtgaccctgagcaagtgactcagcctctctgtgcctcagtactcatctgtcaaatgaggaggatgatgataacaatagtacctccctcataggactgtggtgacacttaaatgagttaatatagataaagtgcttggctgggcatggtgactcatgcctgcaatcccagcacctggggagacccaggccggaggattgtttgaggccaggagttcaagaccagcctgggaaacacagcaaaaccctgtctc

SEQ ID NO: 412178 - DNA, 528 bp, Homo sapiens
gaagccttgtcacttttggtcttgtggcccagttcagctgagatgccacgcggttcttgttgaggggaaggggtgtgagaggccctggtgcctgagccacacactggggctttccatcctgctgaagtcaggaccttcattggccctgattcaaacaaactgattggaaaaagacatttttgagaccatcaggggaaaatgaatgtggatttgatattcagtgatattaaagaatgattataaatgttagatatgataaaggcaagtgattatgttaaagataaaacagttcttatcagagatgcatgctaatgtctgggttgttttaaaatactctagggtaaataaatctttatgagtattttggagtaaaatgatataatacctgggatttgctttaaaatgttccaggctgggcacagtggctcatgcctgtaatcctaacacgttgggaggcccaggtgggaggatcgcttgagcccaggagtttgaaaccagcctggcaacatagcaagaccctatctctac

SEQ ID NO: 412179 - DNA, 553 bp, Homo sapiens
aattgttggttggattcccaggatagcccataaatgatcatttaactcatagtgtagctggagtttctctttagaatcaactcatttgttcatattgaaagcctgctatgtttcaggggctgtgggaaagtgaaagggatgatcctgcactgggcgtttgaggaggttttgctttactaaaccacttgctgccattgtcatgtgctctgttatctcctcctaggttttgttacattatgggttaagtagactttggtgggcgagtctgggaaacgaatttccatatgatattgttctatggaaaatgcatttcctagtttgtgggggaggaaatttataccctttttgctataacaattcattaatgcaaccaatatttattgaataccttctgtgtgtcaaacactgttggaaagagagtaatgaaagatacagaaaaggatctgctgttatggagcttaaattttaaactttgagaggctgacacgggagactcgcttgaggccaggtgtttgagaccagccaaggcaacatagtaagaccttgtctctat

SEQ ID NO: 412180 - DNA, 350 bp, Homo sapiens
  misc_feature (10)..(10): n is a, c, g, or t
  misc_feature (13)..(13): n is a, c, g, or t
cagccctccnaantaactggtactacaggtataaacagcctgagattccagaatattctgtgtattgaccaccacagcagaagaaaaagtccatgtaggactgaatgaggaagaatgagaaggagttgatttctgctgaatccaggagaaagagctttcctcactactaacaagacagaggtgttgaacgagaaatggaaactcatttcccccctcagtttttttctttcttgcgtacttttccaatgccacttccaaattcatagtgaatagcatgattaggaggttttcacatggccctctctgttttttattcctctaaatgatttttaaagttgtccaaggtgaaa

SEQ ID NO: 412181 - DNA, 440 bp, Homo sapiens
atggtagaggtggtagaattgggatttaggtttggaggcagatccagtcccaagatcaaataagctgtgccccctaactttgtggggcagcttagagatggggaaagaacattggccctggatttggctagtcctggatttaaattgtaactctgggccaggtgcagtggctcatgtctgtagtcccagcactttgggaggccgaggtgggcagatcatctgaggtcgggagttcgagaccagcccggtcaagatggcgaaaccctgtctctgctaaaaatacaaaaattggctgggcatggtggcacacgcctgtagacccagctactcaggaggctgaggcaggaggatcgcttgagcccgggaggcagaggtggcatgagctgggattgtgtgtctgcactctagcctgggcgagagtgagagtctatccccccccc

SEQ ID NO: 412182 - DNA, 500 bp, Homo sapiens
agtcatctaactggtgagtcacggaacgtgtcacctgagaggtgtaacaaaagcccccagaggatgcggccatgaacacaacatgcatccaagtgttctcaggtggcagggaggggcagggtggtggaggagggcgccagtcttgcccctggggcagcgagggacacacagcctgtctgagattgcacatcaggctgggagttcctgactagccctgactgctcagagctaaagatggaccctgctcaggaggagcagtacccggcctgtgatggggccagcctgataccccttggccagccccgctctgcaaacaactttctgatgataactcagcccctggaaagtcagacagggaggagggcttcaccagtgtttgtcactagattaaaactgtttctcagctgggcgcactggcgcatgtctatcatcccagcactttagaaggccaaggagggtgagaattgtttgagcccaggagttcaagactaacctggaca

SEQ ID NO: 412183 - DNA, 302 bp, Homo sapiens
ataggaactgtgggcaaaggacaaagctctcttgggtaaagttactcctttagcgcataatgtgaaatgagacagttcttgtgatttgcttagtacattggtcttgacacgaggtatgtatacccaaagagcttacagagactttcgaaccagtacatgggcacacgtggtttttaaagacattcttggagccttccatgtgttctctttcctaaaattgatctgtctgagaattcaccttgaagggggccacccctccacaacctgtgggtgtttcttgtcaggtgggatgagagactgag

SEQ ID NO: 412184 - DNA, 381 bp, Homo sapiens
caaaaaaaaaaaaaaaaaaaaagttacataaaacccagttacttgaatactgtactgaatgattttggcatatttccaactggctcactttcagtcattccttgtcttttttttgtgtgtggggggatggagttttgctgtgttgcccaggctggagtgcaatggcgcgatctcagctcactgcaacctccaccttccaggttcaagttattctcctgcctcagcctcccaagtagccaggattaccggcgcccaccactacgcctggctagtttttgtatttttactagagacgaggttttacttattggccaggctggtctggaactcaagttatccactgcctcagcctaccaaagtgctgggattacaggcgtgagc

SEQ ID NO: 412185 - DNA, 380 bp, Homo sapiens
acataaacctgtaaagtcttttaaaatgcatcttaatctagtaaatcatattttaaatgcataggcagcttttgaaaaactttgccaaagcccatatgcaaattacttgattttacatatttgatttttaaaacatttatgcagttttattaaagctatattggttttttgaacccaagatttggtttctattacaactccattaaaaatgttccctgacttaaattaatattgataaattagtcatttaacattaaaagtggttatgattagaatgagtatcactgattaagcttccatttactctgttgctctgtactgaaagctgaagaaatataactttaaataccaagtcaatttgttttaagtcctcaaaattt

SEQ ID NO: 412186 - DNA, 622 bp, Homo sapiens
tgctttcactttaatagatcgtgcggctgcacacgctttgggtccatgcatttctctaatcgagctgtaacacttgctgctgcggtccatggctccattccttgaagcccacgagaccaggaacccttggattgagaaaaaaccttcaattgggaggatacttcttatctcatttctaggggcccatccgggatttctccacagcactcaagctgagctttcactctctgtccaccactgctgtttgccactgccgcagacacgcgctgacttccatcccttcggatccggcagggtgtcctctgtgctcctgatccagtgaggtgcccattgctgctcccgatccgactaaaggcttgccattgttcctgcatggctaagtgcccaggttcgttctaatcgagctgaacactagtcactgggttccacggttctcttccatgacccacggcttctaatagagctaacagagctgtaacactcaccgcatggcccaagattccattcctttgaatccgtgaggccaggaaccccaggtcagctaccaccaggctagccaccatcttggaaacagcttgcggccattttggaagcgtcccattaccgtcttggtagctctggg

SEQ ID NO: 412187 - DNA, 208 bp, Homo sapiens
cagtgagccgagatcatgccactgcaccccagcctgggtgacagagtgagactctgtctcaaaaaaaaaaaaagaaaagaaaaagacaggggttcagagtgtgagcagccagtaagagtaatacaagagtaatacgagtctaatatatctggttaagcccaactatccttactctgcacctgtgcccaaacaagtgaatgtcgtaagc

SEQ ID NO: 412188 - DNA, 442 bp, Homo sapiens
caaaatgatttatggtatgttttatagtttttaaaaccagtaatgtgaacatttctctatatatgaaaatggatatcttgcaattgcatgatttctaatggcttcataatattgcatcatgtagatttatcataatttactgactctatcacctatttttgaaccctgtttatttcatttttaaataagagcaagcagtgctacattggatgtctttgtgcatatatctttcttaattgagtatttccttaggataaattcttagaagtgaaatagcagggtatgtatatttttaaaacttttggcatacatatcaaaattgattttcagaaaggttattatcaatttatccttctgtcaacattgtgtttgaatttctgccttccaccacccttataaagtcagagtaaaatctttcttaatctttgtcaatctgattagc

SEQ ID NO: 412189 - DNA, 493 bp, Homo sapiens
ccaattttgatgcttcagttttaaaatggtggggggtgaggggctgatggagaagagtctttatggacacaaatggaccagggtgctttgaccttttgttctgtggtctcctcacttattaggtcacataaccttcagtgggctacataaacctcttttctcatctttagcagaacaaaaatctgtggtctgggcttaggggccagttggactgggctttggtcattgattcgcgctggtctttgaaatgtgagtggaagggacagacaggtgttgagtccaagcagaagccttcgatgttcttgtgtggcttggctctgcctctgtgcttctccctcctccttgagaacaatatgccccacatgggagctgctcctttagccaggcctccaggaccagaggacaaatggggctgagcacaaccaagcccagctgagccaggtcagggttcaatgtagcctgaacatgaaataaatgtttataattttaaacc

SEQ ID NO: 412190 - DNA, 393 bp, Homo sapiens
ggcttctcccccttgtcagactttcaaagtacaaagctttattcagagaggaccagaaccagaacttgtcactatagtatctgaaatcatggagaaatgactcagataagactggtttaagggctgggtgcggtggctcacacctgtaatcccagcactttggaaggccgaggcgggcagatcacctgagggcaggagttcaagaccaacatggcgaaaccctgtctctactaaaaatacaaaaattagctgggcatggtggcgggcacctgtaatctcagctacgtgggaggctgaggcagggagaattgaacccggtagatggaggttgcagtgagccgagattgcgccattgtactccagcctgggcaacagagcaagactctgtcttgg

SEQ ID NO: 412191 - DNA, 399 bp, Homo sapiens
aagccaaggagcggccagtcctctcggggctctgtctgccgccctggatttggggactgtgattccctatactgaaaactcacttcaggctgggcacagtggctcacacctataatcccagcactttgggaggtcgaggtgggaggatcacttgctcagaagttcaagaccagcctgggcaacatggtgaaaccccatctttacgaaaaatacaaaaacttagctgggcgtggtggcccgcatctgtggtcctggctatttgggggcgctgaggcaggagaattgcttgagtctcgggggttgagttgcagtgagctgagattgcaccttaccaagtaccacttggtactaaagtgtcttctacactttagcctgggcaacatagtgagaccttgtctc

SEQ ID NO: 412192 - DNA, 347 bp, Homo sapiens
  misc_feature (22)..(22): n is a, c, g, or t
  misc_feature (71)..(71): n is a, c, g, or t
gaggatgaggacaggggactgntctcccgaggagtcccgctgaccctggtcggcactaaatgtcacgtgtncatgtgaagagacccccccaaacaggctttgtgtgagcaacagggctgtttatttcgcctgggcaatgtagtgaaatcccatctctacaataaatcagtaaatatttattgtattaatcttatgttatcttatgttaatctcttattgtgctgtggtcccagcttcctgggaggctgaggccggaggatcacttaagcctgaaaggtagaggctgcagtaagccatgatcacaccactgcactccatcctgggtggcagagtgagatgctgtcaat

SEQ ID NO: 412193 - DNA, 352 bp, Homo sapiens
ctaaggtggaagataagaacagagtgggaatgactgatgaagcaacattccaggaatggagatggggaggaaagaaatggaatcaagggctccaggagagggcttggctttgtgctagaaggacacatcatcctccaaatatgtggaaaggagttaagaaagtgtctatatattagtaagtgctgggcagggtggacaattgatggatgactgtaactttctcaagtaagaaacaaggtggtttttgggagcctgaggcaggagaatcgcttgaacccggaaggcggaggttgcagttagccaagatcgcgtcactgcactgcagcctggcgacacagcgagactccatctc

SEQ ID NO: 412194 - DNA, 356 bp, Homo sapiens
  misc_feature (347)..(347): n is a, c, g, or t
tgaggccaggaggtggaggttgcagtgagctgagatggtgccactgcactccagcctgggtgacagagggagactcagtttgaaaaagaaaaaaaaaaaaaagagagtttattctaaagtattgcaatggggaaaaacaccaggtataagagctgcaagcatgttaaagtttaggcagaaaagggcttagaaattcaggcacacaggccaggtgcgtgtggctcacgcctgtaatcccaacactttgggaggccgaggcgggcggatcacgaggtcaggagatcgagatcatcctggctaatgtgatgaaaccccatctctacttacatagcccatctggtggtgcngctgttccc

SEQ ID NO: 412195 - DNA, 484 bp, Homo sapiens
atgcacaccacctcggtttgaatcctggctctaccactcatagtatgatcttagaaagttacttaatatccataagcctcagctcatttgtaaatggtaacaacctagctatcccacagtattgttgtgaggtttaaatgagatcatgataatgaaataataccagtacaagatttgggggacttgatttaagaaaaattggctggatgtggtggctcatgcctgtaaatcctagcaccttgggaggccgaggcgggtggatcacttgaggtcaggcgttcaagaccagcctgaccaacatgctgaaaacttgtctctactaaaagtacaaaaattagccaggcagtggtggcgcacacctgtaatcccagctactcaggaggctgagacaggagaattgcttgagcctggaaggcagagattgcggtgagccaagatagtgccattgcactccagtctgggcaacaaagtgagacactgtctc

SEQ ID NO: 412196 - DNA, 396 bp, Homo sapiens
tattacttgtaacttctgctgttgagggtttctttggtgaccattgtttctggttagcccgtttttcactggtgttatttaacagatctaaattttgtgaagagttggtacttacggacaggcgcggtggctcacgcctgtaattccagcacttcgagaggtcgaggtggacggatcacgaggttaagataccgagaccatcctggccaacatggtgaaaccccgtctctactaaaaatacaaaaattacccgggcgtggtggcccgcgcctgtagtcccagctactcgggaggctgaggcaggaaaatcgcttgaacgcgggcggagtattgtagtgagccgagatcgcaccactgcactccaccctggcgacagagcgagactacgtctcaaag

SEQ ID NO: 412197 - DNA, 362 bp, Homo sapiens
agcgaccgcctcgacggccagtccatggagaggccctgccagcccgcatggctgctgcaaggacaggtatgaggtcagccaatatgtcccaaattcatggaggaagcactggcatgctgggctgcaagaacaagacagatgcattcttggttcccaagagccgggcggccgcaattccaaaccagtaacgcagagggccgactgtatgtagcgaaattctgtcaacaattaaaatcctctgccagtcgggcacagtgctgacgcctgtaatcccagcactttggggaggccaagatgggaggatcatttgagcccaggagttcaagaccagtctgggcaacacagtgagaccacatttctat

SEQ ID NO: 412198 - DNA, 310 bp, Homo sapiens
gtgctgtatgttcctgttggtccttaccattgcaatacggcaaaaaagaaagaaagaaagaaagcatacaaagaaagaaataaaactgtatttatttgcaaacgacatgcgtatctgtgcagaaaataccaaggaatctataaaacaaaccaatcaaccataaacaagccatcctacaacacataagtgaattcagcaaggttgccagatacaggggaaacatacaaaaaacaattgtatttctataaactagcaatgaatacgggaagactgaaattgaaaatataatactattgacaattgattgctc

SEQ ID NO: 412199 - DNA, 349 bp, Homo sapiens
ccattgctctggacgagacaactgaggcctgcttagagccatcacgccttacccattgagcaagccggcaaactgagccgctccccgctttggtctcccagtgggacttgaacctgccgtttctcaggctggaaggggagcttcaggatcgagaggttggcagggctctacacctgccatccataataatatttcggaaacctccaaggtctcgctacacctcagtttcctcaaccgtaaattgaggatgaagatatttaaggaacgtttaaagctagcgtgtcagcttcagaatttatgttttgtgcgttgttgtaaccccaacgcctagaccagcgcctggaacacc

SEQ ID NO: 412200 - DNA, 310 bp, Homo sapiens
agatggagaaaaagcacttgacaaaattcaacatcctttcatgataaaaacactcaacaaatgaggtatacaaagaatgtagcttaacataataaagatcacgtatgacaagctcacagctaacattatactgaacaatgaaaagttgaaagatttttctctaaggacaagagccagacaagtatgcccactttcaccatttgtattcaacgtagtactagaagttttagttagagcaaataggcaaaagaaaaaaagaaagaaaaggaattcaaactggaaagtaattgtctctgcttggagaagacat

SEQ ID NO: 412201 - DNA, 411 bp, Homo sapiens
gaccactcaaatatgtgaaacatgactgataatggaagggagaaatagttctacagcagtagttggggactttaatgggtagaagaaccaggcagaaggtaagtagggaaatagaatatagtacttgaacaatataagaaaccaagtagatcttacagacatacacggggcattctactcaacaacagaatgcatcttcttcttaagtggacttaggaccttctttaggatagaccatacattaggccagaaattaagattcaagagatttttaaaaatacgataccaagtattttctttgacaaaatgggatgaagtgagaaatcagtaacagaaggaaaactggagactttatgtaaattaagtaacaccctcttcaagaaccagtggtcaaaggagaaatcacaaggg

SEQ ID NO: 412202 - DNA, 429 bp, Homo sapiens
agcccctacagcggccaacagcataggtcacaaagctaagatcatctgaggaccgggcacagtggctcacgcctgtaaacccagcactttgggaggctgaggcgggaggattgcttgagctcaggagttcaagaaaagcctgggcaacaaagtaagaccctgtcttcaccaaaaaaatttaaaaattatccaggcgtggtagtgcaggcctgtagtcccacctactcagaaggctgaagtgggaggatcttttgagcctaggggcttgaggctgcagtgagctttgatcgtcccactgcactccagcctgggtgacagagtaagagactgtctcaaagaaacaaagtatcgggactgggcgcagtgggtcacacctgaaatcccagcactttgggaggctgaggagggcagatcacttgaggccaggag

SEQ ID NO: 412203 - DNA, 388 bp, Homo sapiens
tcagtgtgagctttaaaacataatgtagtgcctccctgcttttttccatttaatagtcccttttggctgaacaaagccaaaggcatgcgtcgagtatcttaaaacttccagaaaaaaagagactgggcagggtgtggtggctcacgtctgtaatccagcactttggggggccgaggtgggcggatcacgaggtcaagagatcgagaccatccttcccaacatggtgaaacccagtcgctactaaaaatacaaaaattagctggcctgtagtcccagctactcgggaggctaaggcaggagaaacgcttggacccaggaggtagaggttgcagtgagccaagatcgcaccactgcactccagcctggcaacagagcaagactccatctc

SEQ ID NO: 412204 - DNA, 615 bp, Homo sapiens
gaaaagggagtttaaacgttgttcactggcgagagtttctctcctttccaactgcccctccaaaaaaaaaaaaaaaaaaaaaaaggaaagaaaagaaagaaaggaaaacaccgcttcagtccagtgaatgagcagttagtcttccatagttgcccatagcttacttttatagtctggactccattcctggtggtggaattggcctgtgaaagagtaatctgtggggtgtagatctaaccatagtagatggtgctttcattccaactctcttttttggtcagacacttgagcccttagaatatcacattctatcgtacatatgctagaaataggtctgttttgcatattctgactgacccttcagatattagtgggcctttcaccaccagccttttggctgcgtgatcttcagctttgtgtatccattatagaccttagtttgattgaaataatattacatgactttgcctgtcttccaactctaagccacttgaggacaaggatgaatcattattctagaatggatcttgaaatattactaagcttttgtttaaattttttccagttctagcttttcagagtaagttaccgtttatagcatgtaagttatgcttc

SEQ ID NO: 412205 - DNA, 464 bp, Homo sapiens
acagaagggagtgggctctttctttcccaaggctccattaaagcagggggtttcaaacttaaaggtgcattagaattttttggagggctccagtcctgagtttctgatgcagtaatctgggatggaaccagaggctacatttctaacaagtttccaagtactcgcagcagctgctggtccaatagctacattttgagaatcccctgctttaacagcatcctatgcccgagtggctgagaaaaaggaccacatgttggaaaggccactggacaggccagaagactagattggatacagctctgctactcagtgctgatgaaatgcagtcaaacatcattcactccaaagagcaccgtttcatccccatctgacataaaacaccacataataagtttgcctctgttctctgtgcattaacctaagaaatgtttgtccttgatttatccaaagcaaagggccaaaat

SEQ ID NO: 412206 - DNA, 415 bp, Homo sapiens
aaactttcaagctcaagtggtcctccctcctcagcctctgaaagtgctgggattataggtgtaagccaccgcacccagccttaattattttctgatcttattgcatagaataggactgcctgtaaactattgaatgtaagaaatgatagtaggcgccgggcacagtggctcacgcctgtaatcccagcactttgggaggccgaggtcaggagatcgagaccatcctggctaacacagtgaaaccccgtctctactaaaaatacaaaaaaattagccggacgtggtggcacgcccctgtagtcccagctactcgggaggctgaggcaggacaatggcgtgaacccaggaggcggagcttgcagtgagctgagatcacgccactgcactccagcctgggtgacagagactctgtctc

SEQ ID NO: 412207 - DNA, 265 bp, Homo sapiens
gctttatatggtggttaagataaatgagttaatataagttaactgcttagaactgtgcctggcctgtagttagtactcagtattcatgtattaccattgctttagccttggccttggttctctattgacactcacaggttgattcacttgcagccgttctggggtctatccaacaagcatccccactgccaaggggtagataatccgacctaaagggaacttgtggagggaagtccctaagacttcactgaatataattaaatgc

SEQ ID NO: 412208 - DNA, 509 bp, Homo sapiens
gtatgtcagttgccaaccattgtaaatctgcacataaatagccattcagaagggctattggggccactgaagtggagctaaagcaaaagcacaggtctgggaatcaaaatacttggggtcaaatccttgtcctagctttgcatttggcaagttactgaggttctctgagcctcggtttcatcatcttaaaaaatggagacagtacagacaaagttcatagtggtaatcacctaagatctgtgtagtgctctccaccaaaaaacacctgcatactcttgtgcagtaccttctttttaactctttgattcccagcaaatagtttgattattttccaaaggatgggcaaatgtggtattactttaatggttaaaattcaggctagagctgggcacggtggctcacgcctgtaatcccagcattagggagactgaggcgggtggatcacctgaggtcacgagttctagaccagcctggccaacgtggcgaaaccccatctctactaaaaatac

SEQ ID NO: 412209 - DNA, 264 bp, Homo sapiens
gcaaccaccaaagggatgccaactcctcgtacctgcctccaatttttatttcatggtcaaattttactaatttggagcaaacacacggaccaaatagtgaagagtttgttcttttaagttttcttaagtcattaagagatactccccagccaggcatggtggctcatacctgtaatcctaacactttgggaggctgaggcaggaggatcgcttgagcccaggagtttgagaccagcctgggcaacatgtcaaaaacccatctct

SEQ ID NO: 412210 - DNA, 655 bp, Homo sapiens
aattcgcggccgcgtcgacagaagacgacagaagggaagagaatcctgctcacgaaagcagaaaacacaagttaaaaattactgagactatttttttttttttggaggatttatgtagtataagatatctatctttcagcatttgagcattttcttcctttggcaacttcctaatcttactaggaagattattagcattagtctgtattcacactgctaataaagacataatggagactgggtaatttataaagaaaaagagatttaatggattcccagttccacgtggctggggaggcctcacaatcatggcagaaggcaaaaggcccattttacatggtagcagaaaagagaaaaatgaggttgggtgtgcggtggttcacgcctgtaattccagcactttgggaagccaaggcaggtggatcactggaggtcaggagttcaagaccagcctggccaacatggtgaaaccccatctctactaaaaaaatacaaaaattagccaggtatggtggcaggcgcctgtaatccaagctacttgggaggctgaggcaggagaattgcttgaacccaggaggcggaggttgcagtaagccaagatcatgccattgcactccagcctgggagacacagcaagactccatctcagaaaaaa

SEQ ID NO: 412211 - DNA, 579 bp, Homo sapiens
ttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctc

SEQ ID NO: 412212 - DNA, 510 bp, Homo sapiens
aaaaaaaaaatcaccttagccactcagagtgcaaagtgaagagaaagtgcctgaaattttagagcttacaggagatgtgacagtgtctaatgcaatcggtaataatttggaaagagttcaataaagtatttttatcaaatgcagagttgccaaaaatctgccttctgcaaacccatcctccacactgtttctggaatggttgctaggtgctagttatatcaaaaacaaagactcactcactcaaacctttttaagagaaaaagggtttgtggcaagttcacatggactggacctggatctaaggctggtctagggccagttcttctgtctggatctcgtggtcttcatgctcccactatagtagcctggcctcctccctttacccaatggacagtgttgtctttctttctttctttttttgaaacagtctcactcctgttgcttggagactggagaggctggagagcgtggtgcaatcacagctcactgcagcctggacctcctgggttt

SEQ ID NO: 412213 - DNA, 459 bp, Homo sapiens
ccctgcctcccaaaacaaaggtaattaacaaactaacatcaaacctgaaggaactagaaacatatgaacaaaccaaacccaaagctagcggaagaaaagaaataataaaaattaaagcagtactaaataaaattgagaccaaagaaatacaaagaatcaagacaacaaaaagttggttgttgaaaatgtaaacaaaattgataaaccactccctctaataaccaagaaacagaagattcagataaatacaatcagaaatgaaaaagaagacttacaactgatagaacataaatatgaaagatcatcagagaatactatgaacaactctatgctcacaaactagaaaacctaggggaaatggataattcctggaaacgtaacctctcaagataggagaaatataatgttgaacagatcataatggtggtgagattaaatcagtataaaaacatctcccca

SEQ ID NO: 412214 - DNA, 533 bp, Homo sapiens
agtgttatgttggtaatttttatgtctgtgttcatcactagcctgccatttcctttttttgttacattcttgtctggttttggtatcagggtaatgctggcctcatagaatgagttaaggggaattgcttcctcttcagtttcttggaatagtttgagaagaagtaatgttatttctcctttataagtttggtagaatttggcagtaaagctattttgtcctaaacttctttgttgggagagtttttattacggattcaatcttgtagttcattattcatctgttcaggttttctgttttttcctgattcaatcttggtaggtatgtatgtgtccaggaatgtatctatttcctctaggttttccagtgtattagtatatagttgctcataatagaatctgatgatcttttgtatttctgtggtatcagttgtaatgtcctctttttttgtttctgattttgtttatttgggtcttctctcttttttcttgtatagtctagctaggagtttttttgctgctgttcatcttttt

SEQ ID NO: 412215 - DNA, 965 bp, Homo sapiens
acccttagaggcaaaaaggacagtttgctgctttctcagagggcacaccgctgttctcagctctttccctacaacaaacgaccttctctgtgaccctccagagcaggacatgaagccatagtgaggggcagtatgaccagcagcttgggaactgaagggaagagactttttctctaggttctatggctgggacctgtgaattgaactgataaaagattaacagtagaaaacgcatacgaataattatttgatgttaacatttttacacggcatagggtagggagaggggctttatagaaagacgtgaaaaccacaaggaagcggttaaatataccattttaacaaagagaagtaaattgtggagattggacaagacaaaggaaaagagggtttgggctaggggcagaaaattgtgggaaagtgactaggaaatatatgagggaaacccacggaagataagagttattctagtaaggtttgtttgtacagactcatctcagcatctgctccctaactccaatgataagaatgttctcctcttcccggtacggggaggccatctttctcatggagaatttatgccttgcttttaggtaaaaaggggcaggacagagagccctaccgcacaactgctgtttctcaactgccttcagctcaaaataatcaatgtgtcaaagagacatattttggggtggaatgttctgatccccattggaactgtgaagcaagtactgtcaggtggtgtgggggcagactttcacatgtcaagagtgatgagtgaaatataagaaagaaactaggctgggtgtggtggctcatgcctgtaatcccagcactatgggaggccgaggtgggtggatcacgaggtcaggagttcaagaccagcctggccaagatggtgaaacccctgtctctgctaaaaatacaaacattagccggacgcagtggcaggtgcctgtaatccc

SEQ ID NO: 412216 - DNA, 253 bp, Homo sapiens
aaaaataatacctagatctttttcatctatcagattgggcaaaatccaagtttgataaggctaagagaaacaggcattcccatatctagagaataaaaatgtaaatttgtataacacatgcagagtacaatttggcatatctattaaaattacaaatgcatatacattttttatccagaagttccactgctgcacttacactcatataagatatttatacagggctcttcattgcagcattgtttacaatagc

SEQ ID NO: 412217 - DNA, 294 bp, Homo sapiens
gagaacctggaagccaggttgaaaaaggccaaaatgggtgcaaatcagctcccaaactttactgtgagaattattcctcagaccctcgctcagattctgttacttttactacatatgcagtctttttagattggattttctgatctcatagatatcagaatagagggtactgctgtcagtagatagcagggtactgtatcagaaaagagggtactgctataagaagcatacacatcagtctagccaaaaataacagcagacagcctctaagcaaaggaacaaaaaagaaaacta

SEQ ID NO: 412218 - DNA, 268 bp, Homo sapiens
ggaatatagtatatattttacttgcacacaacactagacttactaaaatactgatatctataaagaatctagggaaagaggttaatgtagaaaaactgaattaagaacatgggggaattagtcaggcatggtgacatgtgcctatagtcccagctactcgagaggctaaggtgagagaatggcttgagcccaggagtttaagcttgtagtgagctatgataacgccactgcacttcagcctgggtgacaaagcaagactccatctctt

SEQ ID NO: 412219 - DNA, 236 bp, Homo sapiens
atctgcaaaggcaaccccatcaggctaacagcagatctctcagctgaaaccctacaagccagaagagattgaggagggcctacaacatacttaaagaaaaaattgttcaacaaagaatttcatttctagccggctcatgcttgtaatcccagcactttgggaggctgaagcgggtagatcacaaggtcaggagttcaagaccagcctggccaatatggtgaaacctgtctctacta

SEQ ID NO: 412220 - DNA, 537 bp, Homo sapiens
gtacttgcaacactgcctaatgcttgtcctattaagtacactgactcaaattcacttcacttcacttttttttttttgagacagagtctcactctgtcccccaggctggagtgcaatggcctgatctcggctcactgcaacctctacctccagggttcaagtgattctcctgcctcagcctcccaagtagctgggattacaggcgcttgtcaccatgcctggctatttttttttgtatttttagtagagatggggtttcaccatctttgccaggctggtcttgaactcctgacctcgtgatcccccttcctcggcctcccaaagtgctgggattacaggtgtgagccaccgcgactggccttcacttcttttctagaacaattccttgctgctttttataacaaaaagcaggaatagaagagtttttgctattatattttatcagatgctaacatatccctaacttctggctgattcttttctttaatcctttttatctatcagtcaccaaatacttaattgattccttttgctggg

SEQ ID NO: 412221 - DNA, 1996 bp, Homo sapiens
agaaaggtcagcttcaagtgacaaaagccctggctcaagttgctagaatcacccagtttcagtccctttgaggtcttgcaagaagaaatgagataatcgccctcctcctttccgacttgcgctgtgccagtgtaacttagaagggcatcctctctgtgaaaagactggatttacatattttgctaattacagctgtcagattcctcgaagtgatttaagggtggggaggcctaacaagtgtgaagagtatttttagccaagttgtgtgggtttgatagccatttggggactagtaattgaatctaaagcttcatgtgaggccgtacggaagtggtgcgaggtggaaggagaccgaggttgggcgacgtaggtgtggggcagctgtggggtgatttgatcctggtgcgggctggtggtctctttgcctgctgtgacagctgtcagtcagcctgctttatggggtgtgaaattgacaccttctctgctgtctgggtgctggaaggggtacagttggaactggaaacttgatctgcagagcattcatttgtttattcattcaacaagcattttttgagtaaattagagtttctgaaactttcttgtacatacaggatcaccaggctgtcttgttaacatgcggatcctgttagtagatctgggatgggttgagagtctgcctttctaacaggcttttgggtgatgtcgatgctgctggtccagggaccatacctctactcagaaggcctaacactgtatgccactttggtgtgacaagatgaaacactttgagcttcctcaggatcttcctttcccatttgcccagatgttcttcctctggatcttttctgttttttgtattttttgttttttatttttctttgagacaggtcttactctgtcacccaggctgcagtgcagtggcatgatcacagctcactgtagccttgacctcctgggctcaagccatcctcccacctcagcctcctgagtagctgggactacaggcgcacaccaccacacctggctaatttttcatttttttgtagagatgaggtctcactatattgcccaggctggtctcaaactcctgggctcaagtgatcctcctaccttggcctaccacagtgctaggattacaggtgtgagccaccgcgcccagacttcctctagatctttactcggctgtcttcctttcattcctatctcagcaaaaacgtcaccacctagagaaactttgttttctcccatggcccaaatctaaagtagctcccactgcctgttttagctcttagaagacagcctctgagatgatcttgttttgtatttctctctgtctctatgagaagaggagttctgcgagaacaaagcccttgcacttgtctgtctctgtccagtgctgtttcttcctcccacccttggccgagcctagcaggatgcctagcacatagtaggtactcaaattgtgttgagaagaaggtcgcaattcctatctccaagggtcccactgactagaatgagagatggaaaagtcagtaactagttataactgtggtgttgaaaagcagtgtgagaaggagtagaccccaggctgtctgggttctaatccatgtaactctaaaatcgcttgtgcctcagttttctcattaaaatgaggtgaagtaacagtacctttcttatacatctgttgtgaggattaaatctaataaatgtaaagcctgagcaaagtacctggtatagagtggaccatcaggaaatgttagttgtgatgaagaggatgatgaagatgatgaaatggtggtggtggggatggttatggtgatagttgcagggggagagcctaacttttcagggagggcttcacatacgaagtgcactttgagctgaatttccaaaggcaagtagtaatgccttagggcagtgtcttagttaccattgctgttttattagtctgatcttacactgctataaagaactacctgagactgggtaatttatg

SEQ ID NO: 412222 - DNA, 870 bp, Homo sapiens
agaaaggtcagcttcaagtgacaaaagccctggctcaagttgctagaatcacccagtttcagtccctttgaggtcttgcaagaagaaatgagataatcgccctcctcctttccgacttgcgctgtgccagtgtaacttagaagggcatcctctctgtgaaaagactggatttacatattttgctaattacagctgtcagattcctcgaagtgatttaagggtggggaggcctaacaagtgtgaagagtatttttagccaagttgtgtgggtttgatagccatttggggactagtaattgaatctaaagcttcatgtgaggccgtacggaagtggtgcgaggtggaaggagaccgaggttgggcgacgtaggtgtggggcagctgtggggtgatttgatcctggtgcgggctggtggtctctttgcctgctgtgacagctgtcagtcagcctgctttatggggtgtgaaattgacaccttctctgctgtctgggtgctggaaggggtacagttggaactggaaacttgatctgcagagcattcatttgtttattcattcaacaagcattttttgagtaaattagagtttctgaaactttcttgtacatacaggatcaccaggctgtcttgttaacatgcggatcctgttagtagatctgggatgggttgagagtctgcctttctaacaggcttttgggtgatgtcgatgctgctggtccagggaccatacctctactcagaaggcctaacactgtatgccactttggtgtgacaagatgaaacaactttgggaggccaaggcaggtgaatcacctaaggtcaggagttcgagaccagcctgaccaacatggtaaaaccccctctctactaa

SEQ ID NO: 412223 - DNA, 800 bp, Homo sapiens
caagtattctctccaattaattttaatagcaaaccaccatttcctaaaatgacttaaatgggttcaatcaagtaggagaatgaatccaagggaaaccactgactaggggtataaaatgtgccttacatcatattgcatacatcaaacaatcaaagaatttaggcttcaaattacaagaaaaaaaaatacctttaagtcttaccctcaaggtaagataggaaagtgggaaatgctgtctgctcactggcattccataaaatattcactgtaatttctggatttccaagacacatctatctagcagaggtggtttgtcaagtctgagcttttccacctgtccacccctgtagcaatggggctgatgttcacaacctgcagaccatcatcagcattcatggcaccccgacagataaccccattaaactctctccctgactcaggtaaacacttcacaatgtgagaaggtgagaaagacattattactgaaataaacctgaaagctgctctaagtctatagagaaagtgtaacactcacaaatataaataccattacacactatttgtaagatccctcataaatgactatgttatagctgagacctgcaacggaactcccaccaccaaatgttgtggtagtgtaaggaccattgttattttcacttgcaaatattcctgagaggtcgtattttaagctgctaaaaactaaaacaggaataaggtgacaaccagcaaaagaaaaaaaatgagctaatgcactcgagagagtaaggaaggctcacggaagaggagggctgtggtga

SEQ ID NO: 412224 - DNA, 521 bp, Homo sapiens
tatcttcttattttggatattgggaatatgcaaaggctatgaccaaaatttagtaatattatttgcctaattattatttaacttggttaataagccctgatttagttacactatcgataggatgaaaacccttgccttgaaaattggcagctgttgtttttaccattgaactgtacaaagctcttccagtctattatacgcattttttttttttctaaagaaaacaagaaatgattggccgggcgtggtggctcacgcctgtaatcacagcactttgggaggccaaggtgggcagatcacctgaggtcgggagtttgagaccagcctgaccaacaagaagaaaccccgtctctactaaaaatacaaaaaaattcagccagacgtggtggtgcatgcctgtaatctcagctacttgggagactgaggcaggcgaattgcttgaacctgggaggcggaggttgtggtgagccaagatcgcaccactgcactccagcctgggcaacaagagtgaaactctgctt

SEQ ID NO: 412225 - DNA, 417 bp, Homo sapiens
ttccatttatgtgtgtcttcctcaattactttcactgatgttttatagttttcattgtagaagtcttccacctccttggttaaatgtattcctaagcagattattttatttttgtagctattataagtgagattgcattcttgatttctctttcagatgttcactattgtgtgtagaaatactactaatttttataggttgattttgtatcctgcaaatttactgaatttattagttttaacagtttttttttttttgatggagtcatcagggctttctatatacacaattatgtcctctgcaaacagggactatttgacttgctcgtttcaaattggaggccccccttttttttcctgtggcctaattgctctggctaggacttccagtgctatgttaaataaaagtggtgaaagt

SEQ ID NO: 412226 - DNA, 324 bp, Homo sapiens
atctcaagcctaggaggtagaggctacagtgagccatgattgtgccactgcactctagcctggagtctcactgacagagaccctgtcttaaaaatttaatgaactaatttaaacagtttcggttcagagagagtttcctaattcagttttacaaaactgacataacactgataccaaaacctggcagaatttgcatacacacatataaacactaggctaatctaaaaatttatgtgctgtttaataattaatgaacacttattgtctcttacccttgccaggccctgcacgtgatatgcattttatattttcatctttaaaagc

SEQ ID NO: 412227 - DNA, 269 bp, Homo sapiens
cccagaagggccacaactgaactagaaggctaaggaacaccccggccactggtgggatcgcagtgctgagccatgagccctaccaggcaacccatttctgggcagtcccaagacttggagaacaagccatctgaaaatagaattaaatagccaggtgcggtggctcacacctgtaatctcagcattttgggaggccgaggcgtgtgggtcacctgaggtcaggagttcaagaccagcctagccaacatggtgaaaccccatctctactt

SEQ ID NO: 412228 - DNA, 99 bp, Homo sapiens
aggaatatgaaaatatccagcacccagcagataaaagtcacattatttaccatgtaattaaaagtaccagacaggcaaaggaggaggaaagtaagaccc

SEQ ID NO: 412229 - DNA, 309 bp, Homo sapiens
gagggatgcaaatgagctaccctcatttgcgggtataccctatatgtgagagaactccagaaaatgcaggtattcaacatgttcgaggatttgccttggcaacaagtagatctgcttcccacctaactctactgtggctgctaggttatcctgagtcatgtcaaattaccttaaaaactggatggtatggtggctgatgcctgtaatcccagcactttgggaggctgagtcaggagggtcacttgagcctgggagtgccatgatcatgccagtgcactccagctagggtggcagagtgagactctgttt

SEQ ID NO: 412230 - DNA, 347 bp, Homo sapiens
acctgtagaccctggtactcaggaggctgaggtggaaggactgcttgagcccaggagtttaaggttacagtgagctgtgattgcactactatgccccagcctggggaagaaaggaagaccctgtctctaaaaaataaaatttaaaaatagagaatacctcactttcaccaaaactgtaaacccctagagtgattgtactcattttaggccaggcgtggtggctcacgcctgtaatcccagcactttgggaggccgaggtgggtggatcacaaggtcaggctggtctccagctcctcagcatggtgaaaccctgtctgtactaaagtaacataaaaattagccgggca

SEQ ID NO: 412231 - DNA, 195 bp, Homo sapiens
cagaactcacccaaggcagaaccccagggaagagcaggtgcggagaggaaccagccagggaacctctgaccaccatctagggttgccttcttttccttcacagcatggagccctcaggagaccacccactaggttgtctgtaactcacgtccttcttgtcttgaagcaaaacagacataaatatgaatttgcagt

SEQ ID NO: 412232 - DNA, 438 bp, Homo sapiens
aaagcatacaggtcctggcatcttgtccatggcaaatgctggacccaacacaaatggttcccagtttttcatctgcactgccaagactgagtggttggatggcaagcacgtgctctttggcaaagtgaaagaaggcacgaatattgtggaggcatggagtgctttgggtccaggaatggcaagaccagcaagaagatcaccattgctgactgtggacaactcgaataagtttgacttgtgttttatcttaaccaccagaccattccttccgtagctcaggagagcacccctccaccccgtttgctcgcagtatcctagaatctttgtgctctcgctgcagttccctttgggttccatgttttccttgttccctcccatgcctagatggattgcagagttaagtttatgattatgaaataaaaactaaataacaacaac

SEQ ID NO: 412233 - DNA, 369 bp, Homo sapiens
gcccctagagtattcaaccctaacaattactttgttaaataagagttcttgaaataaggaaatttttattattttcagaggattgcatgggagttcctcagtaaggttatttttataaccttactaacaaccatctccaaagagatggttactcccagaagaatcaagaaaagagtagtcaagtacatctatttttgagaagaaatgttactggaaaataaggtatctaatgaggactataaacatgtgagaccggtgctggatgtagtggctcacacctgtaatcccagcactttggaaggccaaggcaggcagatcatttgaggtcaggagttcaagaccagcctggccgacatggtgaaaccccgt

SEQ ID NO: 412234 - DNA, 382 bp, Homo sapiens
gctagttacagttatgccaacaaagaaaacagaagccccaaaagatcactggcttggtaggaagcttagggtatctttaagataacattaaatagtcttcatctgtgggccaggcaccttggctgtcacctctaatcccagcacttttggaggctgaggcaggaggattacttgagcccacgagttcaagaccagcctgggcaacatggcgaaaccacatctctacaaaaatacaaaaaattagtcaggcatggtagcatgcacatgtagtcccagctacccaggagactgaggtgggaggatcacttgaacccaggaggtcaaggctgcagtaagccatgacagcaccactgcactccacaacagagtgaggccctgtctc

SEQ ID NO: 412235 - DNA, 421 bp, Homo sapiens
gatgtggggttggcgacaaagataacgccatcttggggaaggctgacgcttaagtaagtgaactcgagcgtctcgggaaaggtggattgggaggaccggaagaatcttaactgcaattccaggacctgctgcctggcacttttcacacgttaaatagttggttcttaaaagagcgtacgagataaggattattatattaatcttagtagaaataacaagaataatagctaacattaatgtagtgcttattatgggccactttacatatttcagctcttaagaacgtgaactcctgggccgggcgcggtggctcacgcctgtaatcccagcactttgggaggctgaggcgggtggatcaggaggtcaggagtttgagaccagcctgaccaacatggtgaaaccccgtctctgctgaaaatac

SEQ ID NO: 412236 - DNA, 428 bp, Homo sapiens
aattcgcggccgcgttcgacagcacatcagcttttttgctttccatagcaagaaatatttagatatttaaatacttaatttcagttctgttattcttacagctactttttaaataaaagaggtagaagcaaaataaaaagcatgattgttttaaccatataataaattatttgtaatttataattgtagaccagtatatgaatttaattctcagattgtttttttcaatcctaaaataaaagtctcaactatcagctcagttttttgcaaacgtacttattgatatttgatgcagctgttagaaactaatttccaccacttcctttaaagaggtttgttatatagaacattttattgtgacaaacatattaaatgttcccagactaattttattggcagggcttgatgaacctttaagcatcattgtg

SEQ ID NO: 412237 - DNA, 568 bp, Homo sapiens
ctgtcagtgacatcactgaatgggccaccacccccaacttctttaagaggaggctgcatctctgggagatgaatcaggcaggaattaactcaactataattggtgtgaaatagagatgcacacttgcagaggctccctggatatttgttttgatattatcaattcacggtagcttctccataacatgccttacataggagcctgccaactatatccatctgcacctcaaatggcaagtatttaaagatgaactcattgtcttatttcaagccagcttctctgcaaactctcctcttcctctcactggtagcttggtgcttctagtcctttatatgtacttaaagtatccctcagtgagttaggagttagacatctgagaagacgcatgtcaactgcattgttagggatacaagagctgagctgatgacctgaaaactgattatatttgaagctcttctctgcagtgaaaaacctgggtgtgtttatccttgaaccatattaaattcccaaagcccatggaatgtaacctctctcacattctctagtcccacaataaaacagaaagggg

SEQ ID NO: 412238 - DNA, 481 bp, Homo sapiens
gactgaggtgggaggattgcttgggcctgggagattcaggttgcagcgaaccatgatcacacccctgcacagcagcctgggtgacagagcacaagaccttgcctcaaaaaaaaaaaaaaagacaaataaaccttggctactaccatgtaatggttagattaattaggatgcctggaaaatggactaaacccaacaggttttttttttaaacccaacagattttgcaaaaatgagtaactatctaataaagggttgataaaggctttgtaaacactatgctttgtttctccaagtgtggtcagtgaatcaaccacctggggtgctcacttaaaatgacaatcctgccctaactgattcctcattgtcaaacatagtctcaggagggagtttctaataagtaccctctggtgacaccagacactgcagcttaagacatactcccaacccccgcagtatgtcatatgacacaagtgggaaatgg

SEQ ID NO: 412239 - DNA, 241 bp, Homo sapiens
agcagctcttcttctatgccattctgggctttgccctgtctgaggtcatggggctcttctgtttgatggttgccttcctcatcctcttcaccatgtgagactctgtgggggtcacctgcctgtccctgctgctacgactccataccattactggtgctgggatgtgctaagctttacaacatttctctaaaaaaaagaaaaaagaaatagaggtttacttggctcacggttctgcaggctg

SEQ ID NO: 412240 - DNA, 439 bp, Homo sapiens
gaaatggagataattgatagacaagagagagagatgtagagttctgaatggatccacttaagtgaggaagatttcttgaatgatgtaaacttaacagaagtgatttagtagattaatggtttgagatgattttcagaggcacaaaagataaagatacacatcagatagagagaaaagagccatccagaatactttggaactaaatttcaaaaagaaagaattgaggcctataagaaagtactggtagtccacacatgaatttcatggatctcttgttcagatgataagatgatagcgtggatgagggctctgttgttggtaattgagataaacaatcctgctatgagttaaagcctagaggactttttttggtggtacgggtgcagtacttctgaactcctcctgggcaataactggctgtctcctcttaggattcagt

SEQ ID NO: 412241 - DNA, 507 bp, Homo sapiens
tggtgtgctcttgcaattgtaacaggcaaggagcacccttctgcagaagtaaagatgccttgctgaggaattttctaagtgagggtttcttttggctacaccaagcacttgtttccagtaaatcttagggactcgtccgggatcccattctccttcgggaggggctagcgattatctttcatggggagacgcgtcccattgcctcgtggtggccccaggagcggaggatcgagtcccgcccgaagtgacgaataaatccggactctcagcaacgcggacagtagggaggatccttaagaattctgtgagaccagcttggtcaatacggtgaaactccgtttctactaaaaatacaaaaattaaccgggcgtggtggtgcgcgcccttagtcccagctacttgggaggctgaggcaggaaaatcacttgaacccgggaggcagaagttgcagtaagccgagatcatgccactgcactccagcctaggcaacagagcgagactccgtct

SEQ ID NO: 412242 - DNA, 344 bp, Homo sapiens
catacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgccttactggaagttgaaaggtagctgttattatgatcggcgctgggtctggatgtgtggtgttcaaaacacgggctgctgggcagttcgctttcgttttcacgtttttgtgggggtagggcgattgctgcttttttctcaccccgcgggggatcctttagtaacgcgccaattatactg

SEQ ID NO: 412243 - DNA, 488 bp, Homo sapiens
agatacttattcagtaaaaatgattctgatgttttccatctgtttatgtcagaaattcccaagcagcagaaacccaaattgagcagaaaatatccagcctctccaggtgtcactggtgctatcctaccagaaggacaatgaggaagagatgagggaacagggggcttccccaggcctcaccaccaggggggactccagcaggcaattgtggtgaccctacttgtaaggacatcttgcagttctccaaattcccccatgctccttcatcagcccatgtgatgtagatcactgtttctctctttctggaagactcttcaccccttctctcccttaccctgttaatacctgcttggaacatcaatgtaacagagtagttaagagctataaagtgatgtgcttcttactaggtatgtgaccttggccaaactaatctcaccaaaccttaattccttgtctttgatataaagacagtaaagtacctacctcat

SEQ ID NO: 412244 - DNA, 291 bp, Homo sapiens
tgagatgccgccatctacaggatggatctaccccatgctggggccgagtgctgtcatattgagggtctgatctgaggaggaacattcccgagaggtatacttttcctgtcaggccacagggaagcagtctttgcactgtctgaaccaactgaccctaagatggttcaaagccaggcatggtggctcatgtccgtaatcccaggcctgtgggagaccgaggaggaaggaaggattgcttgagcccaggagttcgagaccagcccaggcaacatagcgagaccctgtctctac

SEQ ID NO: 412245 - DNA, 456 bp, Homo sapiens
tgtctcaaaaaaaaaaaaaggaaaaaggaattgtgctgctttttacaatggaagcagagtctcacgacatggaatcacttccggcaacactgtagagctagtcttagacggacttctagcccctgcttttagtcctgatgttgccctagggtacttaaatgtcctaaagaattaataatttaaaaacacacacaatattatcatgttacttgcctatacaaaagtagcttgatggagaagttttgctctttaatcttgtcttggctgggtgcagtggctcatgcctgtaatcccaacactttgggacgccgaggcacgcggatcacgaggtcaagagttcgagaccagcctgaccaacatggtgaaaccccgtctctactaaaagtatacagaaaattagctggttgtggtggtgcgtgcctgtaatcccagctacctgggaggctaaggcaggag

SEQ ID NO: 412246 - DNA, 693 bp, Homo sapiens
tgggattataggcatgagccactgcacccagcctactgtccttttaaaaagatgtaattgagaaaaattgcatatatttatggtgtacaatgtgttgttttgatatatgtacacattgtggaatgattaaaccaaggtaattagcatatccatcacctcacacatatcatttgttgtgatgggaatgttaaaaatctactctcttagcaattttctactaaataatgcattgctattaactgtagtcaccaggatgcacagtagatctccagaacttattccaatggcatataattttttaaatttttatttgcatatttgttgtctatcctaattccctactgatcttactttaacaggtaaaatcctcttagattttctaggattctatgatcagcgaataaggatgttttcttcttctaatagttatgccatggtgtctgattattttctttattatactttttagaaaaccctatgcagtgttaaagaatgctggctacaggcagtcaggtcttatttccagatataaatgcaacaaacgcttccctggttagatgtgatgttggctgttggtttgggatggatagtctctgtcatgttaaggaagcagccttctggttttgtttatcagcactcatattaggaatgggagttatattttacttaatgcctattgtccagttgttgagg

SEQ ID NO: 412247 - DNA, 397 bp, Homo sapiens
actagaacatccttgttgtctcaatcccaagacggaagccaagctaaaaaacaaaaggagcaggacttcacagaagccctaaggctcaatgaaggatgggccattgcacattgcacagtctttttcatatattctaagccatatgcagtacatacagctctaaattctagtaatcatcctgacagaattctaatgaaggaggtggatgagcatttaccagattcaaatgaatgcaaactgaaaaataggcaaaactatgttagatgacaatgtaagaaatcagacatgccacaaattagacctccttgatgggtgaatgacttacagcgggggttacagaaatgctggtatggctgggcgcagtgactcacacctgtaatccagtactttgggaggc

SEQ ID NO: 412248 - DNA, 676 bp, Homo sapiens
aaaatttgtttgtgaaatgatttgacacctaggataatgttactttctctagtgaggattttcatttgcttttgtaggcacttgcagatgctagcaatccagaatgacctttattcaatttcaataattgatatttctagatcctaaatgggagtgctggattatttatggtttacctttctttttaaagcaaagccccttagagtcccaactcaatgtgtttatcagagccccccagcctcaacaggtcccagaatctagcccatgtcaaaccctccatactttttctcatacttgggttagggtataggattatttcagttgtgtgtaacaggcaaacctaacatagctcaggactggaatgacagctacgtaaaggtccctgagagtcagggttcttacagcttactattcctacatctataggatgtcatcctaattctcaaggccctgcagctgttagagggaccaacgtcacacctatattccaggcaattggatttgggggtgaatggaagggttggagagagagcattcctccttcttcttaaaaagctttttggaggatccaacaatacttctacttacattttattggccgaacatagtcacatcatcacatctagccacaagaaaggctggtcaatgtggttctttacctgtgcaaaatgtgccc

SEQ ID NO: 412249 - DNA, 163 bp, Homo sapiens
cagccgtcttgggtcctgaggtggaagccatgtgtggaagatggagggcatcggttagaaggagtctagtccctgatggtcactgagctgcagaaccagcctgggctgcttcctgctggatgtcacttactagagagcgaaattaaatgtgcttcagctactg

SEQ ID NO: 412250 - DNA, 800 bp, Homo sapiens
ccagggggtcaaggctgcagtgagctgtgattgtgccaccatgctctagcctggatgacagagtcaccttgcctctaaaaataaaaaaaaaataattttaattttttttaaatctgctcatttcagatttagtaaaaaaaacaaaaacaggccgggcgcagtggctcacgcctgtagtcccagcattttgggaggccgaggcgggcggatcatgaggtcaggagatcgagaccatcctggctaacacggtgaagccccgtctctactaaaaatacagaaaattagccaggtgtggtggcaggcacctgtagtcccagctactcgagaggctgaggaaggagaatggcatgaacctgggaggcagaacttgcagtgagccgagatcgcgccactgcactccagcctgggcgacagagtgagactctgtctcaaaaacaaaaacaaaaacaaaaaaccaaaagcaaaaacttcccaaaataaaatatgccatggactcttaaaatccaacaataaaaaaaaaaccaattgtttaaatgggcaaaagccctgaatgtatacctcatcaaataaaatgttcagatggaaaataagcataagaaaagatgcttaacatcatatgccattagggaatttcaaaacaacaatgaggtaccctacacaccttttcaaatggcccaaatccaagacactgactataccaaatgctgataggaggggggcggggtcctgcatcctcgggtgagaatcactggtgacgcgggagaatggagagccgaacagacagacatgagagagggggg

SEQ ID NO: 412251 - DNA, 470 bp, Homo sapiens
  misc_feature (468)..(470): n is a, c, g, or t
gctggagatagctgcctgagaagaatctcagtgaggtttgtttttaccattctattgaatggaaactgctacctcccttaattgctttattctttactcttcccatgcatttatgacctagcactatgtattttgcttgttcgttcaaatataaagtcccatgaaagcaaggatcttattgtagtttctgttaaatcccaagtgtctacatcagcttgtggcaagcaaatgttaatatttgaatgaaggatcttgaattgtagttctgcctcactgtcttgttagcaactattttaagagctgcgtcagcatgtttaaaattgtaaagcatatagaagttgacattctaacaatttttaagcatacaattcagtggcattaaatacattcacagtgttttgcaaccatcaccactatccatttccagaacttttccatctcaacaaataataataataaaataaatannn

SEQ ID NO: 412252 - DNA, 1013 bp, Homo sapiens
actccatctcaaaaaaaaaaaaaagaaaagaaagagggccatttcataaggataaaagtccaaattttgggccatgtaaggtgattcatgctgtaatcccaatactttgggaggtcaaggtggcaggatcgcttaagggcaagatttggagaccagcctggacaacatagtgaaacttcatctctataaaaataaatagtaaaggtcaaattttcaagagtacataagcaatcttaaatgtgtatgcacctaattacagagcttcagagtatttgaataataaacctataaaactgaaataaatagacataactgaagatatacagcatgctcatgaattgaaagaataaatattattaagatgccatttctcagtgctgggtaggtagggaattggtgggttggagtttgtggtgggtacttgggccaaaactagaaagacactcagagtaaaaaggggctcacaatgacacccaggacattcaacccccaaggcagcagccaatgatatatatctgtggaggatgtcatgcagaaaatgaaataaaatccagggatccaatcagatgcagagaatgtgtatacagaataatattcaagggactgaaagattggtgggttttgatgctcagtgaaacctgggaattcagaggaatgtcttcacttacacctgaatttccctcttaatgtttctcattgttgtatagctttcggttttgcatatagtagatcccccttatccttgggggatacatttcaagaaccccagtggacgcctgaaacctcagtaccaaaccctttatacactgtttttcctgtatatacttaactatgataaagtttaatttttaaattaggcagagtaagagattaataacaataacaaaatagaacaattttaacaatatactataataaaagttacgtgaatgtggttggtctcttgctctcaaaatatcttacacaggccgggtgtggtggctcacgcctgtaatcccaacattttgggaggc

SEQ ID NO: 412253 - DNA, 688 bp, Homo sapiens
aacataaactacagtcataccctcatgggaaaaaaagaatttaaaaatataaaagtcccattcaaacaatagcagattcaaaaataagaaggaacagctccttcagatgagatggaattagtgcaagaattccagcagtgcaaaaaacagagtatagtgatacctccaaaggattatactagctctctagtaatgactcttaatcaaaataaaaagtctgaaatgacagataaataaatcaaaatatggactgccaggaaactcaataagataaaagagaaagttgaaaaccagcacatacaaaaacagaaaaacaatttaggatatgaaagatggaatagctatattaaaataatagaacttctggaattgacaaattaactaagtgaatttcaaaatatagttggaagctttaacaatagactagaccaagcagaagaaagaattttagagattgaagagtggtcttttgaataaagccagtcagaccaaaataaataaaaaagaattttaaaaaatgaatatagacttcaagaaatatgggattatgtaaagtgactgtacctatgacttataggcattattgaaagagaatttccctaatcttgctagagaggtggatatccagattcaagaaattcagagaacacttgtgagatactaaatgagataagcatcacaaaggcat

SEQ ID NO: 412254 - DNA, 620 bp, Homo sapiens
ggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcc

SEQ ID NO: 412255 - DNA, 737 bp, Homo sapiens
aattgttcacagcaattttctttttctttttcttttccttttttttttggagatggagtctcgctctgtcatccaggctggagtgcaggagtgctatcttggctcgctgcaacctctgcctcctgggttcaagtgattctcttgcctcagcctcccaagtagctgggattataggcacatgccaccacgttcggctaatttttgtacttttagtagagatggagtttcaccatgttggccaggctggtattgaactcctgacctcaggtaatccacccgccttggcctcccaaagtgctgggattataggcgtgagtcaccgtgcctggccagccaatgttttaaatatcgctttccaaacattgttctgtattatttcgcattatgaaatgagttagagtatcaccagtcaaggaagaagctgttactggaagctgaatcccttggccatgattcggcttttcgtgtgtatgtgtgcatgtaaagtctattacttataatagaaaccaatataaacaagtataatactatgactgcttttgcatctgatttgaaaacagtttaatatcaggcaacaacccaagtacagggaaggtatgtgatgtaaaacattcttctgtctttttaaatataattgatttaatcaaattttatcttttattttaatttgatatgtggagagacagcaaaattatgcctaagctggagggaagatttcttcctctggtaggtagtgg

SEQ ID NO: 412256 - DNA, 629 bp, Homo sapiens
taacatagttattaataaaatgttctgaatttccattttgctaccataaatcaaaagagaattgtgtctcccttctatcgttaatttaatctgtataaccttgaggaagccacttactttctgttagtacgagtttcctcatctgcaaaatgaagaatacagtagttatctctcactgttctgaaaactaataataaggtattcccagtgttaagcatggtgcctggcatgaagaaagctcaatacattcttcatactgctgctagtataagttttctaaaatgtactttgtcatttcttttttaaaaaatttaatgacagcctatcatcgacaaattgattgtcattttctttcataaagcccttgtattaattatcatgacattctggactcaaatgccttgatacacattctcaccttttcagttttagctcttaccatgccttttttttttctcttctcctggctctctagcttccacaacttggtaaggtttacactttgcctaaaaactcagcccctctgtttttatctgtgatcagacatttctctaggaaggatttcttgatctttccggtatttatcagttttatcatgtggtgctatcccatacttgtgagagttgtta

SEQ ID NO: 412257 - DNA, 416 bp, Homo sapiens
agttgcccatagcagcctctctattaaaggaaaagcatttttgagagatttggggtacagctatttatttcatttctcagttagtccaaacccgaaccatataaggtaagtcatttgtctcaactggccctatggaacatgaggacactttagattctttggaattaagcagccatatggaacttgtagtgagcttacaactgagacatatggcagcagaatggagccagccttgaggctgtataagcaccccagtgaccatcagcagtcaattaagagttgagacaagagagaaatgtcattttaactcttgttttatgtagtagacacatccttgctgcctttcataagcttgtttcttggtttatgggtcaaactggagccagaggatgttttcctggcttcctcttatagaa

SEQ ID NO: 412258 - DNA, 408 bp, Homo sapiens
aatctcttctccatatattcttaatttcttcttagtagcatttcatgactacaaagtactattatggtaatatttataaatacatatatttttacaattataaaagtaatatataagttttatgtaaaagttttggaaattcagaaaaatgtaaagaaaatcaaagttactgacaagtccatatcttacagaagtatttttaacattttggtatatatatttccataaagtcacatatttccaagtaattatgtgtatgaaacatacatataggcatgtagtttcatttggtaattactgtttagagaactttatatataaaactttttaccttctgcttctggttataaatgaggtagcttatatcacacaagtcctcctattatgaactaccatactgaagaagaa

SEQ ID NO: 412259 - DNA, 599 bp, Homo sapiens
acaatggataagtgttcagcactcttactagctgaccttccctataatatggctcttctctcccttttttcttagggtaggaaaagccatattataggcaaggtcacctagtaagagttggctaaccctctacctaggagacaagaataaattaatcaactccttggtttttctttctacttctagctctctgcaggatggtttatttctcaagcttattttcttattcccttcccccattgctatgatctaaatatttgtgtcccctcaaaattcatatgttgaaattctaactcctaaggtgatggtataaggaggtgggaccttgaggaggtgattatgtcatgagggtggagcccttatgaatgggattagtgcccttagaaaggaggccagagggagctcatttcttctttcaccatatgtgaacacagctggaaggtgccatttatgaaccagaaagtgggctctcgccagacaatgaatctgctagccccctgaccttatacttcccagcctccagaactgtgagaaataaatttcagttgtttataagctacccagtttatggtattttgctctagcagcccaaacagact

SEQ ID NO: 412260 - DNA, 569 bp, Homo sapiens
gttttgacttcttactttcaatgagtaaagtgaacataatattgccctttgagttttctttggatcataaccataccttaaggaaaatatgatttctctcttttacacagccagctccgggtccattggttgtgaaaagtcatgagactcggtctaggttatggtctggagtttcccgctgtggtttgtcaaagatgagacttgaaatggagaagaacatatgccaggctcagaggctagtggacagatagacttcctgtccttattgcaacataaccgtctcttgttcatgctttgggttttctgccttatctcctggaactatcaagacagccacaagccatctgtctttgagggtagatgttgtgttctggtggctttcagctaataggacttttccacttccccctcttttcaaagggaaagccagagtgtatctagttctgtttgagtagggttagagctcagttggcactaataatgtcaatccagattttatagcacttacatgtatattattataatttgagctttgtaataatcctttgggtttactgtgcatgccattg

SEQ ID NO: 412261 - DNA, 526 bp, Homo sapiens
gttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgt

SEQ ID NO: 412262 - DNA, 611 bp, Homo sapiens
ccaaagtggaaaaatatacttatttactcgttttctgttcttttttcctttatcggggcatatttattttctctttggagacttacaaagcaataggttatatgaaactctgagatcatctagtcaaattcccccattttatcaataaggaaatttaaggccagagatattaaagggcccatccaagatcagccaaacaataagtaatagattcaggactagagagttagtccagaactctctcctccatatcacagctgagaagatttagatttttttaaattaatagagctgcatctggcaaaatgacatccggctcacagaagaccctagtgagcttcttgtaccttcccagaaaaacccagaagaaggccaaatctcaattctagaatctagaaggaattgatgtaatttatgaggcatatggaggtagcttggggcaaaagtttccaagtagctcaattcctggcttacttcatgaaacaggccctgtgaaattaaaaacatgaaagctatttagtacttgtcctcttccccaatcatgcctgtcaccttactcggagtcagagctcctgagccagagaaatactagctgatgcttattacaccgg

SEQ ID NO: 412263 - DNA, 461 bp, Homo sapiens
ttgacagcaaatgttcctatctatggattatatataacccgtcctaaacaccagatgaaaaagggataaccccgggaaaggaagggcttgcttccatgtaaatcatgttacaaattggacaacacccagagagttcattgttcaacctcaattgtgaaggccattcccatttactatccccctggaatcgatgttaattaaggcaggctgagaccataaatcagcttgggagttttacaatgtaattcagcattaagcatatatatttaaataaaaagtaactgattaaccactagagtttttccagaagttgctgaggccatttctttataatagagacatgtcacctttcatttttgtgaagagaggaaagaaatattgtcttctaaaaaggtgagttagggctagttaagtgactcacaacattgattattaagaggaagggaggagctgaaaagaga

SEQ ID NO: 412264 - DNA, 357 bp, Homo sapiens
actatcatcaccattgcagggccttctgacttgtcttgggggactgaagaagctgtccagagtggtggttaagaatatgggctctggagtaaactgcttgggtttaaatccttgttctaccacttatcagctgtgtgactgcataactgaattccttcctgtacctcagtttcttccatctacaagatgggaataaacagtttctaccttgtcgggataaatgattttaaaaagacgagaactgtcaggaggttgagttgaaatgaacttattttgattatctactgccattgtttcttcccatgacatatgagtctcttttaaatttatgataacatttcttctttccttcctact

SEQ ID NO: 412265 - DNA, 357 bp, Homo sapiens
ataatgagcctttctctcctttctgacttccctctgcaacattcctttctttactttctcctgacactataggaacagcctttctattgaccttattaattataaaaggacaagattagcatcatgagtatagttctcaaatatagcagcgtataaaatacgaatgacatttttctgtgtgcttacaatgtaaagcaattataatagggatgttatggttggctttataagtaaatattctgatttatactacctgtatctacagctacataattgatatgcaaatttgactttgttttgcataagtttatctggccattatatctatttataaatgtagtttgtgattatatacac

SEQ ID NO: 412266 - DNA, 490 bp, Homo sapiens
ggctctttaaggtctgctcttacttacatttaatctgttagacttttctgtgccagtgacttaaacatcagctctaaagtcagagttgatctttcaggttattagagctggcttataataatgatgaaggtgaatatagtaacagcaacagctaacacacgtactgcctactgtgtaccagacactgttccaaacactttacatatatttatttcagtcatacaaccttatgaggtaggtactactttctcctaaatgtaagggaagaacctgagacacagagaattaagcagtttgcctgtggtcacacagtacagtaactgatagagaagagactatgttatttttagaccttgagttttccacaagacctatgtcttatttatctctgtatccccagttcaaagcatagtagtgttccatccatgttggaattagtgcaaagtgccaggccatcaagttaacataggggatagtgtcattttggtta

SEQ ID NO: 412267 - DNA, 451 bp, Homo sapiens
atttccttggagaggattactgtttaagtcaccttgggatactaccagtcccaggacctaccaatctaggtcctttcttaaatttttttgcttgaggcttttcaagcaacactggtagcataaactgaaatgatagatttctccacttagcaccgagggcatgatttatgtccactctatggtacaatgtgtccctccttccttattcttatcctgaatatgtaagctttatgcaatggtctcatattaaaatctccccgtggagagttcctaggcttcccctcgtgcccccaatctcccatcgtaccatgcagacaacagaaagcagctcagaatcccaatatttggcagaaaatattagagtgaaaattgacattggagcttagttacctccaagagttcttgcagtttattttatttttacagtgtattatatttttattttcatgtc

SEQ ID NO: 412268 - DNA, 553 bp, Homo sapiens
gaaaagtgtactctgaaaaaatctagctgtcatacctatccctccattcctaaccatctcttataagtaattattatccatctcttataagtaattattataagtattttcttagttttccaatttatctttcatgtgtttctttttaaaaagcaaacaaatatgcatattgctgtacttactgtgcctctttcacaacatggggtctttataaaatttctttggatgtttagaaaggtttgtatgctctaatttatactgataacattttatataatgcatttagagtccccaatttgcttgtctaggcctctactatttaatttgacacctttaaatgatgttctttgactcttatctaattgtctatgtgaccgtcagtgaatatattatctgttcatattttctgtagtcttatttctttttgattagaacatataatatttacacactattttcccatcctaatccccacctttgtaataaaattaattaaaattttaaaaaagtatatttaataacctactgatacttacctgaagtctctctggtc

SEQ ID NO: 412269 - DNA, 449 bp, Homo sapiens
agcccagggtctcagcagtaatgacatccaagatgatccttccacagggattattcctaacaagttcagccatggaaatatgtagacatttacatgaataacaaataaatgctttgctgaatctcactctttgggacatgctaggtcccttctcatcttgatttatacatttctcaaaccaaggtgaagacacaaacctgcttaatagtgtcattataatatgtttcatgccactagtctaattttcaaaatgtgctgggagatcttcaaaaattatttcacatgtaacattgtggaattcactacatcatttggtcctaatgccaggtggtatccaaactttgccatatttaccaagttaaaagaaccctgcctttatgttgcaaagtcatcagtaaattgctccatcatattgtttaacccctaacatagcatcaaggagatttgca

SEQ ID NO: 412270 - DNA, 363 bp, Homo sapiens
aaagtgctaggattacaggcgtgagccaccgcacccggcctcctgttgcaacattttttaaaacactgtaaaatacacctgaagtttttataatgcatttgaaaaaactcatatcttttcttgattatgaacctgccattcctactaaaatcttgggaggctttttagagccagaaaaattctacattattcagtggcacttttaaaataaatatggtttttgaaactgcaatgatattttatttatagagaaatgaatgcgtaataagtggattatcagcaaaacaatgttaaacttgtgaattcattaatgaatacgtttttagttacaattctgatgtaccatatttttaagattcacat

SEQ ID NO: 412271 - DNA, 385 bp, Homo sapiens
aggccctaccgcactgccttgctgtaatatatcttcaatagatatatatggaatttagctgaatagccttactgaggtttaaagtcaggttatttgcttacttcacaaaagcaaaataaatttaagtatcctgcactatctacaaattccagaagaaaagcacacatcaaagagttatatgtcacactcacataccatctgaccaataagatggaaaccttcctagcaattttccgaacatataatcaagagttaggaagccatatgcctaatgataagtttgaactagcagtcacctttaaggctatattacattttaaccttaaatttgtctgcagatgaaaattgaaatgtaacaacagttctttcgtaatatgtgctatat

SEQ ID NO: 412272 - DNA, 368 bp, Homo sapiens
gttaacattttgtcacatttaatttctctcttatgtatatgtacattttttacccttaactattcgagagtgccacagacatcatgatactttagccttaaagttcttgaacgtgtctcttctgaaagcataatctcaatactcttgatataattggcatatttatatgatctaacaattctgattccatattctgagtttcccaattgtctgaataatatttacatcctttttcctttatactttttttttggtattgcagtctgtcacttcagatctattaatatttgctttatttaggtacagtaggtttttttttaatctaggtgagccagagattgtacagtgtatttagtcatgtctctttt

SEQ ID NO: 412273 - DNA, 556 bp, Homo sapiens
tttattccagtagtcaggaaactaatatagaaagtctttctgagaagacaacatttgaacaaagactccaaggaggtaagtgcaccagctttgcagatacctggggaagagcactccaggaagaaaaggcagacagcagggtacacgccctgatcaggagcatgtctagcccagtggcatgaagtagagcaagactgggagtcagaagggtaggaggagacaggtgagagagagatttagttgagtcaactcacttacagcttcattatctttaagaacgttggcttagtctgaatgacacatggagtatagaagagtctgtgaatatttatagatattctgaatgtttgcaagataaataaaagtggtgcactggtaaacctggttgggggaaggaaaaaaaagcccagatttgtagcatttgctgatttccattgtgtgaatatttcaaccgatggtttgacaaacatgtcacaaaatttctgagtatttaattttcacctccattagagcactgcacatatgacattccatttgtcaattccatcctgtattc

SEQ ID NO: 412274 - DNA, 439 bp, Homo sapiens
tgaagtagaagtcaaatggtgcccaatccctattcttcactcccttatttctgtgacttgtacctcaactccagttcataccccagtgatggggaattagcaataaagaaatctcatgtgaggaaagagttaatatagcaggtttggtggcttactctttgcatgtctcccagggaaaccttaactatcccctgggaatgtggccaccattcattttgtcactgattggttattgtgttgtatacacctggaacaatggaccatgccataacagcttgtcagggttgctttgctcaagatcaagattgatgactgattcattgttagggtcctgcattacagttgccatggccagttggtagcaggctgtgcatatgtgaccaggacccatctgcacctcagaccttgagactagaactgggcttcccagggtggagac

SEQ ID NO: 412275 - DNA, 442 bp, Homo sapiens
gaagggctaggatcctgctgaaaaccacataatcggtcacttgcagagccaggaaaaaaatccagctcctttgcctgacagtccagggctttcctgggcttgagggccagtagaaactacagacccagaataggatgctgcccttggttccccaaatgactctctgtctccaggcccagctggaaaagggatcagtggttttgcatggagtgtgtcagtgcatcagtttttggattgactttaagatttgggatgaaaagagacagaggtgctacctcggtcagtgagggtctgtcagatgaaatgagcccagactcatcctacctgtactttttgcattatactgtgggtactttcttggcacagaaagcctgtttcacagccaggtggttcctaggagcatgggctctgaaggctgtggatcgtgcatccatctccagcc

SEQ ID NO: 412276 - DNA, 322 bp, Homo sapiens
ctctggagtggaggtgaaaagatagctcgggtattgaaagttacagtgagctatgatcatgtcgttccagcctgagcaacaaagcaagactctgtctcaagaaaaacccaacaatttttttaaaaaaccaaaccacacataaaattgattgatcttacttttgaatatgtggagtgacttaaatcaaatcactgtcatggataatttgagtgaagttattaatcattccattaatttttcctgtgtatgtgagaatatattactgttgattatgacatctgtggtgcatgtacttcacgatttagagctagaagagctttgg

SEQ ID NO: 412277 - DNA, 437 bp, Homo sapiens
  misc_feature (406)..(406): n is a, c, g, or t
  misc_feature (425)..(425): n is a, c, g, or t
ctctacaaaaaatacaaaaatcaggaggctgaggttggggtactgcttgagcccaggaggcagaggttgctgtgagccaagatgtgcctctgcactcaaccctgggcaacagagtgagaccctgtctcaaaaaaaccaaaggccgctgtggtatgagccctgggtttatgtgtcagagtttctatcttccctcactacaaacttaattaagaactatttctggccgggcgcggtggctcacgcctgtaatcccagcactttgggaggccgaggcgggcggatcacgaggtcaggagatcgagaccatcccggctaaaaaacggtgaaaccccgtctctactaatacaattagccgggcgtagtggcgggcgcctgtagtcccagctacttgggaggctgaggcggnagaatggcgtgaacccggnaggcggagcttg

SEQ ID NO: 412278 - DNA, 1086 bp, Homo sapiens
agctttgctgcttcaacttttgcccaaagctcttatctttcatactcctcccttctcggctttcctgaacctggagactatttagcaaagggtctggccactcagaaatggaaagctggggatatttagaaagatggcacctcttttggtggaacctaagtgattctctgaatcctctgttgcccagacacacaactcgagaaatcagcagtgccaagacttctgagagtgtctgcccacccctgactccaccatcgtgtgactgcaattctcttggaggtgttagggagccagaggtgctttgccctctttgtgttactatttctttactcaaaaatatttaagagttcttgtatgcttgggcctaggatgctgttcacagaggagaatgagacaagtaagttctaggcttctatgacatacacattcttatgtgtagagcagacatacacacactgatcaactttttccaatagtgataaatgtgttatcaaggaaatgaactgggcaatgagctattgagtgttggaggtaggtagatagggttcctccagttaggaaggtggttggctgatcttggggagaagttctacctctggggcagtgaggtcctaagggattaagttgagagactctagagccccaacttctgttactgctttagctgtcgtgagtaatttgacagagctggagctttgggagggagagtgaggccacagttcacatttcatcagggatgagtgtctccagggccaaagctcatctactttcttccctgatgaaagaggcagtccaggtggcatctgtgaacaacacattcctgcacaggtaggtgcacagtgctcatctggaagactaatcctgcagggcttcctggaggagatgagcctccacttttcggggcccaggatgggaaagtatgtgagcatgtgtcactgaagggactgtggaaagcagatggaaattgtggaattctctcggaacaatgcagccattattagaactgtgcccataggagcatcaatatccctgctccttgtatcctgttctccagtcttctggggaccccctttgactgaacccaac

SEQ ID NO: 412279 - DNA, 1145 bp, Homo sapiens
cttgcctccttaccctccctctctcacgctgacacataaaatccaggccaagatcaatccaactgttcaattgtgtgttcacccaggctgctgagccctgagagaaggaggagatcattcatacaaatatatataccacagccgtgaaaaatccatgattccattttttctaagtattcccactcagcttgccctctcacctccctcagaggctttcttgaaattctccttttctcctcagtcccctacaatcatcatttcctccccactataatctcagtggatgaccttatccccccttcactgaaaaaaataaagtgtccatatcccgaattctcacctgccacccaaacacttccccatctgcaccatctattgttcctttattcctacttcagtggaaactgtattctcatctgtactgcaacccagtatcttcactccattcccactaacctcaaagacaatgtacaatcattcacacacacctcctttattctacatcttcaacttctcccttcctttttcctttttccatttagcatataaacatgctgaagtctctctcatctaaacacagcctgcccctctacctactatcttgtatctccctatgagcaaagcttcaaaaagagcaaagctttctgaaaagaatgtttgcacttactgtctccactctcaacaaatatccacgcttagtcctcagcaacctggcatttatttctattatggagactccactgaagctgttctacagaaggtggcaatcagctgcttaacaccaaaatcaagggacacttccctgtcctcatattcattcaactgtgggctacatttgacattgcagatggctcttaaaatttttatcttcatttaataaatatttactgaaagctactttgttgataagaacttcagataaaatgatgaacatgacacagtcacaagccctcaagaagcttaaagtttctatgataattcctactcctccttccacctctcagatcactccttccttctctactcaacctttagagctgatattcccccaggattcctttctttgctcttctcacatccatcccaggattaatgtgtttacattacctattcattgatgttgacgaaatttttatcactagctt

SEQ ID NO: 412280 - DNA, 776 bp, Homo sapiens
agcctgggcaacaagagcaaaactccgtctcaaaaaaagaaaaaaaaatctttactttggataaatacttagaaatggaatttccaggtcggcctttagatattattaatggatttaatatgaaaaacctttacttgaggatgtataaagctttaaaagacagggtccctattcttaagttataagtaaagcagcatttgtaaggtaatattcagaaaacatcagataatatcctataaagtcctcctgttcttgctgatgacattggatggccagttaaggatgacacttcattctgtcctctgcaaccacggtcctgacatgtctaaatgatacttgccctatgagaacactgtggatgtgaaagcatttcctcaggttatctttttgacctgctggttttaatctaatgatgggatatccaaagtgaatctaactgagtgacatgattgtggatctgttggggggaatcagagacagctagagcaagggcagacacgtgctgaactcatctgtcttaagagccgaagaaagcagcagtgttactagcagagctactgcacatctgtacacgtggctccaatggctctgacctgtttttttcccagtatgaacctaatacatgaggcaagttagaaaatcagagttggccaggcatggtggctcatgcctgtaatcctagtactttgggacccaacgtgggtggatcacttgaggccacgagttcgagaccatcctcggcaacacagtgaaaccccgtctctactaaaattaca

SEQ ID NO: 412281 - DNA, 656 bp, Homo sapiens
  misc_feature (642)..(642): n is a, c, g, or t
  misc_feature (656)..(656): n is a, c, g, or t
agcctgggcaacaagagcaaaactccgtctcaaaaaaagaaaaaaaaatctttactttggataaatacttagaaatggaatttccaggtcggcctttagatattattaatggatttaatatgaaaaacctttacttgaggatgtataaagctttaaaagacagggtccctattcttaagttataagtaaagcagcatttgtaaggtaatattcagaaaacatcagataatatcctataaagtcctcctgttcttgctgatgacattggatggccagttaaggatgacacttcattctgtcctctgcaaccacggtcctgacatgtctaaatgatacttgccctatgagaacactgtggatgtgaaagcatttcctcaggttatctttttgacctgctggttttaatctaatgatgggatatccaaagtgaatctaactgagtgacatgattgtggatctgttggggggaatcagagacagctagagcaagggcagacacgtgctgaactcatctgtcttaagagccgaagaaagcagcagtgttactagcagagctactgcacatctgtacacgtggctccaatggctctgacctgtaatccagctactcgggagggtgaagcaagtcgctttggaccccgnaggcggagttgctn

SEQ ID NO: 412282 - DNA, 699 bp, Homo sapiens
acgcccctttgtaatctcttttcgtaagtaaatttcagtctaaggggaaatatgtaaactaggggatcgaggtggctttttaggggtgtaactcgttgtactatcactgggagagatgaaaggggttagggtgaaaggtataaatgaatttgattccaagagcaatctggaagggaccttcgcctttgacaccgatgctgtttcgaatgaacttttgtttttctaagtagtcaactaaggaaatgttaaattaggcatgactttaacttctgacatgatggctcgtatatttgtgtggaacaaaatgttgggagaaagttgtggagttttacatgataattgtacatttgctaaacatgtttttttttctttttaagggcagtcaacgacatttttctccattaatcccaaagtcagtgtaaaagttgtttgtaaatatcattgccaaaacaagatggaatgtagagatacttgattgtcgcaatttagggaatggggttattgttactaatgactttttttttttaccatgacatagtgtatttgttaccactggatctcagtctggatgttataaattcgatacttaatcttattaaatactctgcacattttattaactaataaataggacacttaacattcattgtactggttttgaaaaaccgacttaatttgtaagtgtaacaagatacttac

SEQ ID NO: 412283 - DNA, 495 bp, Homo sapiens
gagaccgtagtagagagctaccaaccttctccaccttgcattgagcaaacatcagagcaacagcaaccctccactctggcctcagaaactggagaggcacttgcccttttgaccgtgcctgctgtgcattaaacagcaaagagttggcatcgcacatctccctaactagaaagctctgttctcagtaattgatataactactagagtgaaaatcagcaggaatataaaataaatcagtaacatcacaagataatgggatctagctgatatttatagactacttcacccccaaacaggaaaatacatgttcttttcaactgcaactggaacattcaaccaggcagaccgtcatatcctatccataaaacaaaccctaacaaatttatattgttagaccataatataattaaactagaaatcaataactgaatcaaggggaaatatattttgaagtgaacaaaattgaaatgtataaatatttacaggatgcagtac

SEQ ID NO: 412284 - DNA, 177 bp, Homo sapiens
agtgtgtgagacaaatagtaaacaattaagtgagccaagcatataatatgccagatggtgagtagtgcaatgaaagggaaataaaactagaaagagaaataggtcctgttatgactgggtctatatcttttgatttggtaaattatatttacacaattatgaatttatttgtttagc

SEQ ID NO: 412285 - DNA, 521 bp, Homo sapiens
agacatttggcactccctgaaagtattttggttgtcacaacccagggggcgctactaacatctagcagtagaggccaggaatgctgcctaacatcccctgatgcacaggacatcttctccagacaaagaattatcccacccaaaatgtcaatgtgctgagattgagaaaacctggcctatcagaacccttcaactcctgattgcttctgaaagagatgacacaatgtagttgcctcaacttgtaagaagtcctaaaggacagatctgaaggggccccaagtccttacaaactaaagccaggcagagagtgctgcaggtccccattgatcatcccttacagggtttcacgacatctccctctgctctgctcactctgtcttcagaccaaagaccaagttaggacatcgggcacttagggtgtctgaacagtcaacgtgaaggactccttttggcaaacaccagtagatcttgtcccatgcccttgggcaccagttttggacataataagctatcattgctat

SEQ ID NO: 412286 - DNA, 565 bp, Homo sapiens
  misc_feature (552)..(552): n is a, c, g, or t
  misc_feature (555)..(555): n is a, c, g, or t
tttgaatttcctgtccttcacttctttttttaattgagttgggtttgtttttcatgtcaatttgtaggagttctttgtatggtaggaatattaacccattgcctttcatagcattacaattatttgctcctaatctaggccaaatatttcccttaatctgtagtttatctctaaatttcttcatggtgtctttctttggatttcttttttagttggtcttgacactcaatttgggaattcattttccctgattggcagcccatgtacaaggatgaagaatatagaaaacaggcagctgtctttgtttcttaagcagggagacaagaaaagataaggctcaggctttagctagccagaaaagaaaatagtcttcagttcagagcaagaaaaccctttattctagaaatgttggatttgcttagctgatgcattcaggatcctgagcaggaatcctgggtaccaactagcttctgaacaggtgcatagcttttcgcacctagccacttcatctttctctaggccagccttcagctgcctggcccactgaggcanttntccagctctg

SEQ ID NO: 412287 - DNA, 554 bp, Homo sapiens
tgtgtacatttataaatggcacggtagggatgggagtgggctgggggtagagaattccgtaaaacaagggaacttgaggaaatgcaaaagactgaaaaaaacctggcatcttccaaagggtaaaattagtatgattgtttaaactattttgtccttaattttagtcatttctaatttaacagctaaagaacaattactgtataataactgaaatatttagtatacttggtattacagcaccctctatcacatgatcatatacagaatacatttctatgaactggttgctttaatctgtgaacatttatgtagctctctactggttctagggtttagtttactacttcccatccacggagtcaaaaggactactaacttgtgcaggcttagtatcaccagtatattttagtaccgctgcctgcaacagcagcattattgacaaagcaatcctgaactctttattccaggtgtggtcctagtaccaacagcatcagaatcacctgagattttactagagctcccttccagctgtatccttagaccttccctcccag

SEQ ID NO: 412288 - DNA, 482 bp, Homo sapiens
tgtctaaaaaaaaactaccagtggtaatctatgtagtagccattgctagtgtgaggtggatattttaaaccagtcacagtctgtcattccatggactaaccaagtctctgtggaaagcatttggtttcacagttaatctaatttgtggatcgcagaacttctaggaagaagtccttgtcagcaggaaggctacagggggagcagtgagtctgacttggtagctgcacacgagaatcacccggagagcctacggcccagcacacttggtgctcaccagaccagctaattggcatcactaggggtgggacctggccctggcattcttttttttttttgagatggagtctttctctgtcgcccaggctggagtacagtgacgccatctcgactcactgcaagctcccaccctgggttcaagcgattctcctgcctcagcctcctgaatagctgggactacaggcgcccaccaccacgcccggcta

SEQ ID NO: 412289 - DNA, 588 bp, Homo sapiens
agagaacagctcatacacatgctgtgtgtaaataacaaaaacataaaactgaagcaaggtccttgtaagaaaccgtttttgtgtgtcatcatttttctgctttgcacaggccaacatttataatgagtatatttctgggtaaagcaagcatgaagaaagactacaatacaaattccataaaaggctatagagtgtatgaaattcatgaccaatactgactacacaaaaatcttaattttgcacccagataattcttagcattttaactaaatacagcttagctcacactaagtgattctgcatgtcctagttaaaattaggaacaacatgaaaactagttaagtgggttcctacaaaacagtgtaaagagaaagtcctctcactgacaagcaattaatttataagcacaaaacccatatttgtactatcaaaattacaaatgatattcaacaatcattttttgctgggtgaagtttcaatcactagctaacttcaaaattttagtttaaagaaggagaaagagttgtttggtctaaagaggagagagattgttttatcaaaagcccaagtcatgcctgtgaataaaat

SEQ ID NO: 412290 - DNA, 478 bp, Homo sapiens
caaccatggaaagcctgggagagtgattgtaagactggcctgaagctttggtcacctctgttgtctgcagaggcagagaaccattatgatctgtaattgccagtaactggattctgaagctctttgagtatctccagctcatgggcaggggaggggaaattaatgaaataaaacaatattggctttagatttttatttttattttattttttttgaggaataaagcactcataggccacactttgatagtgggaatgtgtcatgaatgaaaaagaattaacaaatcaaaaacagtcggctctttgtgatctagagaaggacagaacatgttaaaacctgcttccgccatgagcaataaatgctgagcagttcattttatcttcatcccaaagccacgcctgcccagtgacctctgaactggaaggagctaaggaaaggacgttgatactttctgagacatgtatcttcctgtatgctg

SEQ ID NO: 412291 - DNA, 553 bp, Homo sapiens
gaatgtagcctccgagatctgggtctctaaaaatttaccattcagtatatcagaaatgggttagattcaaatgaggaaaaactgtagttggtaaattttgtttatatttccatttaaggcaaatatatattttatacacacacacatatacatatggaatatatatatggaatacatatgtggaatatatacatatatggtatatggaatatatacatatatggaatacatatatgcatacatacatggaatgtatacatatgtggaatatatacacacgtggaatgtatacatatggggactatatacacacgtggaatgtatacatatgtggaatatatacatgtggaatacatacacgtggaatatatacacatgtggaatatattccacatacacacatgtggaatatatgtatatattccacatacacacatgtggaatatatgtatatatatggaactaccttggccatcattttgttaagaaattctttttcccttaaagtaacaatcagaaaatgtgggccaaaaacttttgcttttggaatttg

SEQ ID NO: 412292 - DNA, 232 bp, Homo sapiens
tgcctctgggccctgttcttagggaaatggctgtttcccaggcagaccccatcagtcagtcttcaggtacagccggagagaacacttgctgtatctaaagcccctgctggacaatggggaaagaacatccagaagacacaggaagtgttctgacttcagagcacttaactgttttgctaaaccaacccatatcatagtgtgacagaaagctggggtcttaagacacattggg

SEQ ID NO: 412293 - DNA, 486 bp, Homo sapiens
tttgtatttttagtagagacggggtttctccatgttggtcaggcaggtctcaaactcctgacctcaggtgatccacctgcctgggcctcccaaagtgctgggattacgggcatgagccactgcacccggccttctttctaacttctttaagctcttgtcatctgcatgttccctttttctagcattctattctcagttcatggatgtaatttatttctcagaaggtgagatttatagtcttattgtttccaagttcctttttttctttctgtttttattttgatccctatcatgttaagtagctttgtttcggttgctggtttttaagatagaaggaccaaaaggttgattataagttgagatctggcctgggtgctgtggctcacacctgtaatctcagcactttgggaggctgaggcaagaagatcacttgaacccaggacttcaagaccagcctgggcaacatagggagactccctctctaca

SEQ ID NO: 412294 - DNA, 513 bp, Homo sapiens
gcacacaagtctggttcaacattctgagtcaaacactgtactccaccatatcaacagaagagatatacaatcatattaattgatgcagaaaagcttttgacaaatccaacatctactcacaataaaaactcccagaaaactagaattagatcctcaatttgataaagaacatccacaaaaaatccacatctgaagccttttcaagaaatgttgtaggtgcagttggtcatccatgggtggggtagcgtggagggaggatggagaagcttatcctaaaccttccacctgctacacaaatcaactaaaagcagatcacagacttaaatgtaaacataaaaccataagagttctagaaaagataggggaaattcactgggacacaggggtaggcaaagccttcttagacttgacaacaaaggtataacccataaaaagtaaacttgataaattggacctcatcaaaattaaaaactgccctgcaaaagacattttaagagcatgaagcgtaaaact

SEQ ID NO: 412295 - DNA, 740 bp, Homo sapiens
agacgcactgaatggaaaggttggcgccagaggcagcaggtctctcctgccccctactccaccggcgcggggaggagcgtgtgaagcacgggccattggggttgggttcctttctggaggacctcagggataaggacacgtcctactgaaactgggggccgggtacgtgggccatggggcccatcttggggtggggtcttggggagacagaactggcacaggagatacacagcacgccgcgatcgttagcaaaagtcgtaagtttccctcgttccggacgcacctcttcaaatcatttccaaaagaggtggcaagttttccatcctccgccccaattcttcatcttcctcttaattggctggggttcgggtaggcccggcccaagatcgcttgttgattggctgcgttggtaatctatcacaggatgacgcacgcgaggggtggtatttgggggaggaagtgaggattattttggtacctcctaccccaactactgattggctgagatttgcagtgatgtaaaacaagacataaaaatgtccactaaagggaagggtctgtttgccattctctctgggccggggggactctgttaatgtagagaaggaccaaactgattgaaacacggaaatgagtttagaaaggaactgaaggaaaacgagggaaatccgcgacaccttcgttgccttcaaacaaggtcatttcctgcacgggatcgatggtttcctgtttactgcctc

SEQ ID NO: 412296 - DNA, 91 bp, Homo sapiens
ttttgaattatattatgattgaaaagcttgttttggagaatatccagattaattttatctgaaaataaagattacattttctttttcttgt

SEQ ID NO: 412297 - DNA, 385 bp, Homo sapiens
aattttcttgtatttccacaaccaaaaaatcaataggaatatttaataaaatttattgaagatatgattttaccagaaatacatagatataaaagcaattaattaaagcttttaatattgctttctacatatgatatgtacttgcttaaatcactgctaatttctggtaattaaatttgatgtgtatctattgaggagctactcagtccctagcatggttgatgcagtgattcccagactctggacttaactgatcagtaatgttccttataaaattgcggagtctaacctagggttgcctcctttttattttatcaagtaaaaatctagaactgaatcaagaatttttaggccaggcatggtggctcaagcctgtaatcccagc

SEQ ID NO: 412298 - DNA, 286 bp, Homo sapiens
gggttgctgcgaggctgccgcgggaggtcagctgccccgggcatgtggtgtttctttctttaaatcaggtcaggctgagctagagggggcggaagtctgggggcggaggtcgcagggaggcgagcgcagggggtcaccggcgaccccagagcgcgcattagaggggcaacctctggttaacttcaaagactcccgtgtctgcaagttggaccattttaaggtgctcttccggattgcttcaggggaagggacctcattcccttctctctctctctctccccccctc

SEQ ID NO: 412299 - DNA, 558 bp, Homo sapiens
tgaacactccctacatcagtgactgacccatactctatgttaatgcagctcagaggccagaaagtaaaaatttcctttggtaactgcagaatacgtatagcatggatgctaagctgacacttggggataacatcccagtaagacatacaagccttagagttccctgagattctatgactcttctgctttaatgagagaaacgtcaaccacaaggacctaatggaagggagaggtttgtggctctaatttcctcttgggttcaaatgtcaagttagacctggggaagtctctaaatacttgagttatcagacacatctattaaatacttctcagtttattatttttaaaacttaaatatgtatttcaaactttcttatatgtatcacaattaaaataaaattttaataaagtgacctgtgtcttctgaccataggagagtaaaaggcataaaaattgagtatcaagtttctatgttagataacactaacaacctgggtaagttttaattcattcccataaatgctaaccctggttttcttcatcaaagataaccctgag

SEQ ID NO: 412300 - DNA, 224 bp, Homo sapiens
taatcatgttgtgagctaataggtcattagaaacagtttttgatgatcatgttgaccatgtgatcttcgtggcatataattcagaagttcagaattgagtgacagttccataacaaagcttcttccagcccatctacatatttatgtaaatgaggtttcccaatgtaaatgaggtttcatatataaaaatgaaaaagactaaaattgattctgaactgtacatt

SEQ ID NO: 412301 - DNA, 597 bp, Homo sapiens
agaactcaaagatatcagatatcatctgccctcctccccctccctttttcataaatgaggagccagagactcagagaggggatatgactcagagaggacaatagatagagctcacaagttagtggtagagtcagacctagaatacatagtttcaaattctgtatctggtaataataacagtataattaattgaagcttttctatgcatcaggcactatcctaagtgctttaaatgcattgttttccttaatactcacaaaaattcctacctcattcctaatgaggtaggcttattattgctgtcatttcagtttgaggaaactgagtcacagagagggtatgtaacttgctcagtgtcatccaccttgtaaatggtagagtggagactaaaagagaagcagtttgatcccagggcctgactccttcactgtgctctgcttttcccaccccactaagctgcttctaatagggccttccatatgcagttacagcattagcacagtaaaatctccatagacagctgcacaagctccccatttagttatattctgacagtgaagtactgaatagcagaaaatgtggagtctgggaactgtc

SEQ ID NO: 412302 - DNA, 398 bp, Homo sapiens
tggcgatcgtctgggtcggatgaagcgagctggagtggaaactatgtgccctcgatgggtctcgtgggggcgccgatcgtccacactgagcgatgaacccgacggagttctaaagctgaagacgtctgcccccgccccgttgcgctccctgggtccaagacgagagtttaatttcttctgtcttgacttcatccccatccacccctcccttttctttatttgcctctgcactggtctcttatgatcaggttctagcatttccggagtctgacgataaagccagcccttaagttgcagggagtttacggtggacgaagatgggtgatgcgcactgcctttgatccgattcggcacgcacagaatcttgttcttttcattcaagcgcattttttctttgg

SEQ ID NO: 412303 - DNA, 492 bp, Homo sapiens
tgagccgagattgcgccactgcactccagcctgggcaacagagtgagactccatctcaaaaaacacatcttcactctggtttgcctgggatactttgattataccagtggttgtgatatcctatctcatttagcattagttctagacaaaagtgccctgataaggactttgaatgatatgggcatccttattgtaaggagcaccttcccatctgttttgtagaaatggctggtttaggagaaggaagggaccataaatttgcagaaaagaaatatacagtgttctctcaggctttttcttctaaattaaacactttagtctttgtaattgaagggaatttctgcttcacttctttcattttctgcctaatttgtccattttatattactttgctgcttctctgctcatttttctacttcttcatgctttgtcacctctatcctgtatataaaagcagatcataatgcttccagaatattttattttgaatag

SEQ ID NO: 412304 - DNA, 562 bp, Homo sapiens
gtgatggagagcctatcagtggttgccagaagttaggagtgagaggagcctgtgactaaagaggggcagcaccagggagttctgtgggagatggaactgttctgtgttcttgactgtggttattccaatctatacatgtattataattcaactgtctactaaagaaaaggtcatttttaatgaataaataacaataacaacacagcaaattgctgctgaactgtccccacactgaaattgtgctgagaattttctagtttacctgtaagcagcttcactaccatacatttagccaagtttccatgacagcaggcaattagcattcaggagggcctttgagtggtttggcggtaaggcagttgctcagttcagccatctttaccttagacattaagatatccaaaataaatgatttttctgggaaaataaaatttctttctaaaatatttcaattttaactgtaagcattccacaagtatgtggttaggctggtgtatatcaaatgaattaactcttccatttaaaaatacatagagtaaagcttgtgaacaatctctggctt

SEQ ID NO: 412305 - DNA, 540 bp, Homo sapiens
atcaaggcacaaagacaagtggaggactagaatcttctgaggaggtggaggtactacatcactggtggtcctgaggcccctaaaaaaactgggaggtgggccctgggtgtagatgagcccacttaggcctaagatatctacatggccgagagacagaatataaagccccactttcccctagcccctcctaccttttcataagccttggctttcttacctcactggtgaatgtgcctgatcaagaatagtgtctctattcttgcctcaaggaaagaactattattttgtcagctgggtatggctgagacatcatagtatgctgagaaatcttccaaatgcatgtgctatagatgtgaattaaattttagccttctagttaatatatcactaaattctgtgttccttaatttttttattactctcataacatgaacaaattttaatactccttaagtgtcaaaagttgttcttaaatggccagagtgagctacagctgcaacatgatggccagtttgagaacttccagttggctctgcagtt

SEQ ID NO: 412306 - DNA, 541 bp, Homo sapiens
gaagtgacactttgttacaagggaacttttattctgtttctttccatttagaatgataagctgcgaagtgtttcctaagtagaagatcttcattatggattgttgttagctattgtaagggacagccttctgctaaaaacaaaaccccttcacagtttcagtagggaagaacactggaagcaggtgttccaggtggatggagtggctgctcgttgatgtcaccctgacgcgtcctcctcagtggtgtctttctcctgggttcccactctgactcctcctttcagcttgtagggctggtccataccacttgaaattagaatcctattctcttgggttccataacacaactgaaattgtttcagagtgttcaaaagagaaaaggacaaaaagaatcattgggggcagggggacaaaagaggaaaaacatcaggtttacaaagtagagcttgaatttctgcccttgcggtcggtgctcactgctcagcacagtcacagactctgtttttattggtggtggtggtggtggtaggagtatcagcat

SEQ ID NO: 412307 - DNA, 462 bp, Homo sapiens
tacactctatgcctgcttatctgtttgaaagggtaaatgtgactctccatcagattggaatccttggttctgctccccatgacttgtacttgtagctgtgaaggacaccagggttgtacttgtagttgtgaaggactctggggtgtcaacgggccttcaaaaggctgaaatgagagcggaatgagagcggaagtcggagaactaccacccaggagatggaaacattaagtgacaatctaccaggccctaaaggagtctgaccaaataactgattcacaacagaacccaccagaaatcatggcctgagacttagcacctctctttcagatggtgttggctaaatgcccataaatccttgtcccctgaccccctcctcctcttctggggtcttcatgaacccttcccttatcctcctggtaaggaccctctcccatttgcacgggagctcccacagcctgtggc

SEQ ID NO: 412308 - DNA, 599 bp, Homo sapiens
caaagtggtgcctttttatgtccagcctccagaagtgtgccaagcaattaccccaactggagctgtatgcaagtagagaccttgctaccttctgcatttgagggaaagtggattgtttttctctccagtaatgctatccaattctctaactccaaagcatcaatcagcctcactctccttacccattctgggttaataattcattttagagaacagacattaggaaagaaaactctttgttttatggtttattctttagggcttaatgggctctgaaaccacaactccctgaggcaaaggagcctataaagtatacaaaaacctggccattcattcctacaggtggaggaaaggggagataccttctcattaagaaagttttctaattcagtgagaacaagccaaaaatgaatgtcttagtttattacctcaccaaccagtggaaaccaagaaaagtgaactctagtaatcacagaaggcttcacagaaaaggaaaaagtttgaataaggttcatggggatgataagaattggtgaggagagaaaccacaataacttcagaactgcggaaaattcagcagaagagaagtaaaaatgaat

SEQ ID NO: 412309 - DNA, 353 bp, Homo sapiens
aaatctttgactgtatccctgaagccatgtgatcttttcctccagtagcaatccataacttgagtacaataaaattggctgtaggagtcatttgaaacttgctttgcaggaagggtacacaaaagtacaagaccaagagagatgacaaatacagatgaagtaattcagtgaatgaaaatggagaggatcaaggatggaaggcaggaagtaaagaagacagtaaaaaaataagttgctgggcacggtggctcatgcctgtaatcccagtactttgggaggctgaggcgggcagatcacctgaggtcaggagttcaagatcagcctgaccaacatagagaaaccccatctctact

SEQ ID NO: 412310 - DNA, 431 bp, Homo sapiens
ggggaagagatggggtaaatgcttaattttaacttgaaatctttttttctaattaaagtagtaagaattctgttgtgtttttcaacgtttctaatagaaaatgtcatgcataataaaaaagagactggagtaataacccctgtgtgcccacaacacagttttactcattgctgactaatcccaatctgatttcttcttcccctgtcttgaaacatatttgggacatcatatcatttcagctctaaatgggtcagaaggtattgataaaagataattttttttttaatcatgccatgatcacagctaaagataaattaacgatgattgcttagtgtctttgggtacccattcgttgctctcattttctcgttttgtttgaatgtttctctaactaaggcccatgtgctatgactaactgacatgttgcttaa

SEQ ID NO: 412311 - DNA, 554 bp, Homo sapiens
ttgatggatttttcatagaagtgctttttttggtggtttcagaatatttgtaaacattggtggttaaacagcagcatgattgctgataatataagatttaagattagttctgacttttaatatataattatatgcagttttatcacttcagcttagcaagctgcaatagcaaaacatagaatagtatttttgtgcaggattttgttcttctatttaatgtacacaaaagtaatttgactaattttgctttcaataaaaccatctatttatttaatagaaatattttttaatgtgggaattgaactggtgtttagaaaacatcttaaacaaaaaggcattttgttcaagatctcctgcaaatccaagtagtatgggtattaagaatcctgtctgctgagatgggtgaggcagcagcagaagggagagtctctcgggtggcctggagccctacacctaggaaatggcatttgatgccaccctttggtgggcaaaatgcccctgttaggagattagactccaaaatggtagtatagttgtcacatttctcccagatc

SEQ ID NO: 412312 - DNA, 494 bp, Homo sapiens
  misc_feature (210)..(210): n is a, c, g, or t
  misc_feature (435)..(435): n is a, c, g, or t
  misc_feature (458)..(458): n is a, c, g, or t
  misc_feature (469)..(469): n is a, c, g, or t
tattacaggcgtgagccacggtgcccagcctaggaaagactttttagcgggcatgttatggctaagagtcagcagagggccatgattgacagtcttaccaggtccccactgcattcctgcattccagcctgggcgaaggagcgagaccctgtctcgccaagacttgtcaactgatagctttaaggggaatgtatgctgattcctaattgntatcctccatccctctatcttatctcctgttgcaatcttaaatgatggctggatgactactccattcctctggatgttctacattctcttgcctgaggtagatccgtttgcttgggttctgtcaaggagatggggccagcagtgtgtttcaaggcctgtgtgtggtctctatcccggcttttgcttaatctctggtttcagtcttgcctatcagtcccactgtcnggggtaccctcgggctgggctanaaccttttcangttgctgggggacagtgccttcttg

SEQ ID NO: 412313 - DNA, 354 bp, Homo sapiens
ctctgacaaatacaggcttctgataacttcaagatcataccatttggccagaaatgcctcttattagatcaccatatagaggcctaactttgatgagagctcacctgcaatatctcctgaaatgagacacaactgcttaattgaattgacctattctcagcactaagacaatgatttgatatggggcaatgtacttaaatttgttcagctgcacttgttccaatctatgttttcctcttcctttgccaatccctgatctcacaatctctaatccaaatctcttcaaagctaccaacttggagagttctaagccaccattttgagttactttgtgttgtggtttctcctgcattg

SEQ ID NO: 412314 - DNA, 574 bp, Homo sapiens
ggttggttgatatttatggttgactgacttcgcactgggaagaagttacagaagcaaaggtatgtcctgtaactactattgattttattgctggtaattttatcactatggacagaaaaccttaatggaactgggcctaatctagccagggttccagtctccctatatgcagtcagactttatgatttaacaccaattagggagactgctctcctatataatgacacatatttaaaatcagaacttcaccatgatacccttgactatattagtagagaacggactgaaactgacattggttcaaaggaaactctagaggcaaatggaatacccctgtagtttcactgtatacaatagggtttttaagatcagtattcagggcatatttgaaaaggaaacaagtcatccttatttggcgatggtacccatgtgtaatacatagaagtgtttttttattcctctttctatttaaatcataaccattctacctggcagtgtgcagatgcagatatgacagagaataaccatgacaatcacatcattcccaattggtgggtaataggatctcctttgc

SEQ ID NO: 412315 - DNA, 557 bp, Homo sapiens
cactactgaagttcctcttcttacaaacaggtttggcttcaaaattggaaaggtcttttgagtgtaagtccaaaataattaagaggggtttaaccttgcatcctccagatacatttacatcaaacagaaaggtaaattagtctttcaaagcttttaaaccagatagacgcctcttcttcacgctgatttataatctaaataagcagcctttctaaaatggaccaattttgacaaatttaaaatttgttgaggtgactgttctttacctagccttgataaactatacaaatatcagagaagccctcagaggttagagtactctgtggctaccctgtcatgaactctgatgttgtgtgaatttaagggcatagaacctatggaactttttatgatttgtgacacatgtttcaaattgattatctgggccaggcacagtggctcatgcctgtaatctcagcactctgggaggccaaggtgggcagatcacttgagtccacgagctggagaccagcctggccaacatggcgaaaccccatctctactaaaaatacaaaaat

SEQ ID NO: 412316 - DNA, 591 bp, Homo sapiens
gctctccaagcgttatactccgctttcagcagctaacaagcgagctgtggaatggggctggtgccaccccacatcggctgggaaggcctcaaaaaaagccaaatcctgtttcaaatcttgtttatgctccttcctctcttccccagcttcaaatcaacagatgcttctagtctgggaacctaggggagttctcagggccatgtatcctgtttcttttaatagaattgcagcctgactaaggtaaaaattagtttcctttttatattctttaattccttgtcttcactctttaatcaaatgtcttgttttaatttttccttgccctgtggcgttggcttatgtctagccacaaaatgtcccatttcatatacgttttaaaaagtggaccacaggaggaaatatttcatccaaagggaatattatagtttgaacacttaagatctagaatcaaagagtctgcagtaggagtcagtcacagaacacaaataacagggccacagaatttttctgttaaacagaaaaagtaagaaaggagtctacataatataaacagcagtttaatgttgctttcaaaacatcgaaatgtgaaac

SEQ ID NO: 412317 - DNA, 315 bp, Homo sapiens
ctcaatctctctctctctctctctctatatatatatatatatatttaacatatatatgatatatatgtcataagcgtatatagatatacatatatgaagcgagcgtgggcatgattgattttaacatcgatttaactcctcttatgtacatggataggtgacccaattctaacatgtgtatgtttgtgtgtgcatgcacatgtgtgtgtaaatgcaggaatgtggagagacgtgttctaatcttagtaaagtggtacagaatcacaacgtgttttctctttgagtttcaatcctagctccaacagtaattcctgt

SEQ ID NO: 412318 - DNA, 162 bp, Homo sapiens
cttgttgctgagattacaggcgtgagaaccacagttcctggcctaaactgctaaactatttctctaaagttactgcagtaactaaataagtaatccactgtgtgaaaatgaggaggttctttctcattttgatatactctgtcctaaatggaagtatgtggt

SEQ ID NO: 412319 - DNA, 336 bp, Homo sapiens
  misc_feature (203)..(203): n is a, c, g, or t
  misc_feature (219)..(219): n is a, c, g, or t
  misc_feature (289)..(289): n is a, c, g, or t
  misc_feature (297)..(297): n is a, c, g, or t
gggagcacctgaaattgtggccacatcttggagaactccagtcagttgagttgaagaaattgtactttgtcttagcaggggtcagcaaactttctgtgaagggccagaagtaaatacgttaggttttgtgggctgcacagcctctgccataattactatgaaagcaagatgagtgaatgttgtgagctcattactgttactgnaaaagagccgtagtgnttcagtatgaactatttttatacacacacaaatatcttttcttctttaaactagaatcaggtgctctggntttcattntataaatggaagggccctggagagtctggtttttgtttt

SEQ ID NO: 412320 - DNA, 508 bp, Homo sapiens
gtttcctgtacagcctgcagagatgtgagccaattaaacctcttttctttataaattacacagcctcaggtatttccttatagcaatgcaagaatggacaaatacacagatcctcttgaggaatgatgtattgagttgggttatagtcaccctctctccagcacactgaattcttctttttcgcataaacttgttttgttttgaatgaattcctgctatcaatcagcacacacaacacaaacatgtctgactaaggaaaatcactccattgagtgagagccttatttcaatattcataatcccttaaaaaatatatgtacactcatacatccatgtgtgtttactaaggccctcttgaaatgaaggcaaaaagaaaagaaaatgcccaaacgcacagctatatgagctaatgaagcaagcatattacagtgattaaactgtatcttaaactctaaataataaaatattgacattttgaagaatttgaataacagcttacacttttttt

SEQ ID NO: 412321 - DNA, 502 bp, Homo sapiens
ttaaaaataggaaatcagtagaggaaacacaatgaaaccaaaagctggttctttgaaaagatcaataaatctgataaacctctagccagactaaccaagaatgactcacacctgtcatcccagcacttgggaggctgaggtgggaggatcacttgaggccaagtgttcaagaccagcctgggcaacataatgagaccccatctctacaaaaaatttgaaaattagccaggcatcatggcacgtgcctgtagtcctagctactcaggaggctgaggcaggaggattgcttaagcccaggagttggaggtacagtgagctatggttgtgccactgcattccagcctgggtcacagagagaggccctgtctccctgaaaaaagagaaaagaaaatgagatcatcattactaatcccatggacataaaaagaaaaggctacaaacaattctgtgcacacaaatttggataaattagatgaggtgggctaattctttgaaagacaca

SEQ ID NO: 412322 - DNA, 546 bp, Homo sapiens
  misc_feature (139)..(139): n is a, c, g, or t
  misc_feature (417)..(417): n is a, c, g, or t
  misc_feature (468)..(468): n is a, c, g, or t
  misc_feature (499)..(499): n is a, c, g, or t
ccatggttgaatgttatgacccaatcttgggagtaggactaggactagggagtgttttctcaaacttcagtgtgcataatgaattaactagaaataactttgcaaggagagccaaagctaagacccccgaaaccagacnagctacctaagaacagctaaaagagcacacccgctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagaggcctaaaagcagccccaattaanaaagcgttcaagctcaacacccactacctatccaacatatactgacttctnacacccaattggccaatctatcaccctatanaagactaatggtagtataagtacatgcattctcttcgatgcctgcgt

SEQ ID NO: 412323 - DNA, 233 bp, Homo sapiens
tttacctatcttgctcttattcttctacggctgagtccattttatttactgtattcattacctaacagttccttttagtgctcagtaaatattcattatgattgtacaatgcaaggataagtgtagaagttctaagggttcaaaggagggattcacaggcgtgagccaccatacctggccgaggtcaggggtttgagaccagcctgagcaacatagtaagacctatctctacc

SEQ ID NO: 412324 - DNA, 544 bp, Homo sapiens
gtttaggaaaaactggctcactctatggacagaaataaaggttagtctccagactttatactccatatacagtctcagtgtattaaagacctagatatgagatggaaaattataaagctaatgaaagaaaaatataaaaaagtatcttcataacctatgagtagctctacctataggtcatgatgatacttttctatattttctttcattacccataagtagggaattcaaatgcaattcaaatggcgaaacattgatggattccattgcattaaaattaagaattttttttgccaacaataaaggacaccatcagcaaggataccaaataggcgacagagtggaggaagtatttgtgatatctaaaaatgacaagggattgatatctagcgcatgcaaggaattattgcaaagctacaagaaaaagacaggaaataatagaaatatggtcaaaggatgtgaataggcagttcacagaagggaaaacccaaatgactaacaagtaatgaagaggtgctcaaacccacggatattcagagaaatg

SEQ ID NO: 412325 - DNA, 396 bp, Homo sapiens
ggaaatgctagctgcctttctccccaggtgctttcatgcatatgtcccttttactagaacaaacattaccattctcctataaggctgggaaacttgagacagccactattgttccagatgatagtttttgttttcagggatgtatcaatcatattttagccagaaatttaacaacacaaacttgacagtaattctttccttctccctcttcaaacactcatggtctgcttcattcagtcacctcctcccgaggtcagctcctaaacagcagatggtgtgcttgtgtgcagcagctggcttcattcctctccataccctccttctctcaagggacagtgcgtgtgtgcctctgtgtgcgtctgtgtgtgtatgaacattcacgactttcagttgcca

SEQ ID NO: 412326 - DNA, 552 bp, Homo sapiens
cccaagttctagcctgccacccccactatttccccagtcctttaactaaattagctattccattgacaggccagcactggtccctcacagaacaacacatgctgtgctctctctgtgagtgcactcgtggtgaactttgagccacacatctgctgcagggaagaaactcttattcccaaatggctgacattagctgaggatgctgggttcatcgctaccatagcatattgttattagataagctgctggagaatcagaggagtaaatttagttattatgtctttacctcattatagtgcattcccaactattgttcatttcatcagcttgatattgttctatgtttctacaaagtgaatgcttggattaaaaccagtatctactctcctttacccctaagccattgctgtatctaggctaaggatgtattttcaccatgtcatttctccaagactctttctttgatttaaagcatgaatcagcaaacatgttctataaagggccagatagtaaacatttcagtcttttttgggccatatgacctctcttgca

SEQ ID NO: 412327 - DNA, 420 bp, Homo sapiens
gcatgaatctatacactctaaactaaatctatacactcaacaaactttaagtggcataaactcaaagaaatccacaccaaagacacattataatcaaactgttgaaaggcaaagacaaagagagaatcctagaagcagtaggagagaagtggcgtcacaaacaaagaatccagaatatgagtaatggctgatttctcaacagaaaccatggaggccagagggcagtgaaacgacttaatcaaagtgccagaaagcggaaaaacccacatgtcaatgagcagatgaatggataaacaaaatgtggtccatccatacaatggaataatttagccacacacaaaaaaataaggttctgacacaggctacaacatggatgagcctcatgcaaaagactatatattatataattccttttacata

SEQ ID NO: 412328 - DNA, 317 bp, Homo sapiens
ttcttgccacaatgccagttcttgagttatttctttaatcatatttttcacctccattatacttggcatacaactttcaaataagatctaagaaatatttccaaaattttaccaagcgtactaatggagggagaaattcgggagggcacaagcacgagaacagggtaaatcagaaattattttcagtcttcctatggctcaactagaacaagcatgtcaagggaggaataaaatatttttaaaacataagcctaaaaaaacatgtatttctttaaacatgaatattccatactttaacaatcctaatgtaatttata

SEQ ID NO: 412329 - DNA, 539 bp, Homo sapiens
tatttgatgttcagtttcctgcaaactgttgtttcatgtattttatctgtttctggttgtttcatacaagaaggtaatctagtccctgttactctatattggtcagaagtataaatctgatgtatagggatttaatttcaactagaaactaatttgaagagaaggatatgagggctatgtcaaacattaataaaggactggttggataaattatgatatacctatataacaaaattgtgcagctgatcacaaaaatgaactacagatgagctacagttacatgttttggaaagttctctaaggaatactgttagtgaaagaattaaattcatccttttatttcgttatcaaggaatatttattgagcaccttcttttattttctttagagacaggatctcactatgttgcccatgctggactcaaactcctgggctcaagcgatccttccacctcagcctcccaactaatttggaggctgagttgggagaatcacttgagcttggtaggtcgaggttgcagtaagccctaatcacacca

SEQ ID NO: 412330 - DNA, 429 bp, Homo sapiens
  misc_feature (336)..(336): n is a, c, g, or t
  misc_feature (367)..(367): n is a, c, g, or t
  misc_feature (427)..(427): n is a, c, g, or t
gatgacctagaggcaaccagcattgtcagttgtttaacttttaatagagatttgtgcatatacagcaaatatgtatatttataaaaagtaaatagtagccagctatgtgcacttttctggcacattgtgttttttcacttaatatgtcttgtagagcattacatatcaacacataaagttttcacttcttttttctgatggtatatgttacactatttggttttaacataattatttctatattaatatttaggtcatttccaaccatttgctatttcaaacattactgggataaataaacttttccctgtaatcccagctgctcgggaggctgangtgagataattgcttgacccaggaggtgcangttgcagtgaactgagatcgcgccattggctggcagcctgggcaacaagagcgacttctntt

SEQ ID NO: 412331 - DNA, 539 bp, Homo sapiens
tgtcacccaggctggagtgcagtggtatgatctcagctcactgcaacctctgcctacagagttcaagcaattctcctgccttagcctcccgagtagctgggactacaaactcataccaccacgcccagctaatttttgtatttttagtagagatggggtttcaccatgttggccaggctggtcttgaactcctgatctcatgatccacccgccttggcctcccaaagtgttgggattacaggcgtgagccaccatgccaggccctctcctaccctttcttatgaccaaacaatagtcatttttatggcttctaactgggatgtatgtgactatagccaatgaatagagaaaagctaactgaaatgatactgccttatggtataacaagaaaacaaataaattttattgacttccatataccactagattaagcagacaatccattcaaaattttcactctaattttttttgctagtatctatggtaatttacaataatattgaatgaatttaattattgtattttgaagttattagaaa

SEQ ID NO: 412332 - DNA, 654 bp, Homo sapiens
tttcatccagtgggtcacagtataaagaataaaagtcactgcctatgtagtcacagaccatcaggccaaatgagtctagataccaaaactgtactgtcctgccagttacaagttaccaatcttttgttgttgctaaattaaacttgtagcgccataatttaatccatgccttgccttagtcccaaacatgaaagtcatcaacatttcaacctttatattctcacaaattatttttcctcttagctgcatgaatttcttcttccaagtgcacttagagcaggtggtaaacatcccaactcttctcattcaagcagattcatggaagtttagtacttagaaacaatagtatctccatttgggagagaaaaatgagaatatccagcaaaccagtcctaaatgactgattactgaagatcagatataactaatgacttcagtagttgaggtcagtattaattccagcatttttagcatagacaggagaaagggaaggagatgatcatattatcagtggatcctgtgaagactaaagaggaaaggtctgtagtgatttagaatctgagcaggtctctttggttgaaaaactatctaggttaactcagcgtacactagcctgcagccttctgaaatgggcgcaggccagccaccttctag

SEQ ID NO: 412333 - DNA, 785 bp, Homo sapiens
cgatcttctgaagatcgacatattatagcaatcattaagacagcccaggcaaacataaagacagatcgtgtaaacaaaaatgtactctccccccaagcaaactgtatagtctcataccacttacagttcttacacatttagtaaattatagacgcggagacatttcttaaaaagtctgacttcactttcaaggaattcttcaattaactttacgttgctttaagctgctcatccaacgagaaaacaatctgtggttactgactcctttgtgtgccaatggcgccataatttaatccatgccttgccttagtcccaaacatgaaagtcatcaacatttcaacctttatattctcacaaattatttttcctcttagctgcatgaatttcttcttccaagtgcacttagagcaggtggtaaacatcccaactcttctcattcaagcagattcatggaagtttagtacttagaaacaatagtatctccatttgggagagaaaaatgagaatatccagcaaaccagtcctaaatgactgattactgaagatcagatataactaatgacttcagtagttgaggtcagtattaattccagcatttttagcatagacaggagaaagggaaggagatgatcatattatcagtggatcctgtgaagactaaagaggaaaggtctgtagtgatttagaatctgagcaggtctctttggttgaaaaactatctaggttaactcagcgtacactagcctgcagccttctgaaatgggcgcaggccagccaccttctag

SEQ ID NO: 412334 - DNA, 359 bp, Homo sapiens
  misc_feature (81)..(81): n is a, c, g, or t
  misc_feature (86)..(86): n is a, c, g, or t
  misc_feature (130)..(130): n is a, c, g, or t
  misc_feature (157)..(157): n is a, c, g, or t
gcccagtgagccgggcgccggaagaaccgttgtctgccacgcgcagccccttgtgcgggatcaagcccgtgtgggcgaggnggggncgggccgggcagggcttgggctgggccttcctgagggggtgctngcgaggatttccttcgtccacaccctnactctacgccctgccctgggcaatgccgctactaagtctattctgatgacttccacatatctatctggtcagcttcttcctctttcttttctttttctttctctttctttctttctttctttctttctttctttctttctttctttctttctttctttctttctttctttctctttctttctttttcttctttctttttttg

SEQ ID NO: 412335 - DNA, 355 bp, Homo sapiens
aaaaagaatggaagcccatgggccatagggataataacaaaagatcaaacattcatatcagagtcccagaaacagaaaaggagcagagctaaaaatatatttgaagaaagaaggccttaaaactacccaactttggcaaaagatgtaaacctacacattcaagaagatgaatgaaacccaaatagaataaatgcaatgaaatccatgtctagaatatcaaatccaaatttcagagaattaaagacaaaactcttgagagcactcagtgagaaatgacacatatgtaactatttctcagcttcggaactagtgacattttgtgtcaaataattctctgctctggtgggctttgctg

SEQ ID NO: 412336 - DNA, 667 bp, Homo sapiens
attctttgccagaaaaatccttccgtgacatctatttgcttacaaaaattgtgccccaccttcttagcatggtttccaaggctctctggaaactgatgcaaacctttctttctttctttctttttttttcctggcttgtgttgtgtttccaccaacttctccgccctcaacacacactgacacatgctctggttgccctcttgtatgtttcttcttccctgtctccatctgtggaagtcttagaaattattcagtacccaacttaaatgttgcttctttctctgagtctccctgttagaaatagcctttccttgctgtaaaatttcatagacttttatgcttttgtcagagtatatgttacctctaggcctgtagatgtgcttatgccatctccctttctgctatgtgaggcacatggaaaataactcagaacttctggtcagattgatttaggttcaaatctcagctttgccagttactagaatttatttgttttacatagatcacctacccttactcatccttttttctcattctcaaaagatcttaaaataacttcttagggtcatgaggattaaatgatttgacttatgtaaagtacttaatgctcttacagcaagtatttgataagtatgcattcatttttctttttcttttttgaagtgta

SEQ ID NO: 412337 - DNA, 515 bp, Homo sapiens
agaaattaattttttaaatttattttttgttttaggtagttaatacatttcatatagctgaaaaataaaaaaagtataaaaagatatatatctcatttccattcccctacctcttataggcaatcactattgtttcttgttatctcttcagtgctgcttcatgcagtagcaaagcaaagaagtatgtactcttaatagcccttttaaaaacttttaaaaatgtgaagtgataacatatacagaaaacataaaacataaatgtcaaatgcaccataaatgtcagctcaatgagcccttatgacaaagccaacacttgtggactcatatatagaactcacaactaatattccaagaaatagaatgtcgcagcatctgagaagcttctcttatggccccaccctccttcccggagaagttgattatattaagttgatttatagccctagagtttagttttgcttattttaatctacgtattcttttggtctggcttttgttcagtattcttgagattt

SEQ ID NO: 412338 - DNA, 633 bp, Homo sapiens
aaaagcaagaatgctggtctgacaagagctgtgaggacaaagtggagagtaacaagagatgagggtgaagaggtaggcaggggccagagcatattgcaccataatgcccatggattttgagtataattgaagatcgtgtgacaagatctaatttacattttacaaagtttattccacctactgactggcaaactggctttagaaaaggcaaggtctgaagcactgaactatttaggaagcttttgcagtgatctaggcctatggtttccaatgttcaggaacaaactgttaaaactattatattaactatttatattgctttatttaaaaaaattaagctttactaatatttaatatacagattggcactggcatccttgtcttatctgcacgttagtcacatgtcatttaacatttttggcttgagcaactggtgaatgttggtgccatttactggaatgagaagactgagggaggagcagggtttgttttgaggtgagagtgagttggggaatcagtatctcagttttgagcattttaggtttgtgaaatctaaatacctactagaaatctaatatcaggtagatggtttagatatatgaatctggagccaaggttagaagccaagattag

SEQ ID NO: 412339 - DNA, 446 bp, Homo sapiens
ctcaccagcatggatcaactataaactaaactgcagaaggcactcatgccctgggtgagctatgggcagagaaaaactcaggagccccagacacatgtggtcagtgtgtatctgggtggaggcgggacgttccgagcattggagctgaccccatgcacagcctcacaggctggaaccaggcgtctttgagtggaagaagtcaagggagtcccattagagaaggaccctctgtgttcactgtgcacctgggagcaaggtttctcacaacagactctgctgctgaaaaattagtgtttgagttctaactggagttacagaccttggtgactttgcatagccctcttgacaagcggggcagccttgccaaatgacacatgggaagtggagggtgtgcagcaaatgctatttgtacgtgttggctctgggagtggcagagtatttctgag

SEQ ID NO: 412340 - DNA, 291 bp, Homo sapiens
tagagcccaatccactttatttgataacagttgcacttagcaaatgcatttatgaaaataatgcaagctttaacagtatatacagtaaaataagataaaataagctttagtgtacgcattgcccaacctcaacaactcattgtcagtcttgtttccactatgttctcattttcttcccaacctacaagattcattttggaagaaatcccaggcatatcttttcatttaaaaacattcagaatacatctctaaattactatcattctttaaaataactaaaatgttattaac

SEQ ID NO: 412341 - DNA, 527 bp, Homo sapiens
gatgtgtctcgaggatgaggtcaacccgaaggggtttcttgagaagcagtgacttcttctggactttggttctcttcttagccctttttccttggagccggtgtccacgaagaagagtttttcatttggggcctctctcaacaagccaccgctcatgcgcccctgtagccgcacgtcttccaggaactggtcaacctccagccccagcggctcctgcgcaagcctccgccagtcccacttcttatttcttgggcctcgccgccgccgccgcctcagcgctgggtccgccgaaatgggccgcagccccaggaaaccagaatcgttatcgcttttcgagctgtgcttcccaccaacgccactgcctcctgccgccatcttgtcaaaggccctcctctatcttatttcttactgttccttttctcttttgaaatatatacattttaatctattatatcaagttacttaaaaatatctaccagaaacatgaaaaatgtgctatgaatagtaaaatttggcataacactgag

SEQ ID NO: 412342 - DNA, 449 bp, Homo sapiens
gagttggggccaataataagctgttgtttgaagtcactaagctttcagatggcttgttatgcagcaagagagaaacaaaatagcctcgaagggtatctgggccacgacggcatttcagaacattcacacagatacgacaccagctgctggcaaaagagaagcccccacactgagcctcacgtaccaaaggccaaaggtaagcgactccacttgagatcgtctgtgcggctacgtcttccgtaagaatccacgaacactccaaattctgcaaggtgtcaagagcacgtgggcattagcacagccaagagcaggggcatcagcgacacacatggtgatggaagaatgaggagcagagcccagggacccctggccagatgggactgactgtgaaaaccagaggccctctgctgagccagctctcagctttattaaaaatgagggacttttta

SEQ ID NO: 412343 - DNA, 481 bp, Homo sapiens
tacgcccatccccgaaaggtctgcagtgagacagggagaggactggggcaaagaccagcctgaggggtttcatccaagcagcaggcaagactgccttccctgagccattgcaggacatgaggacatgagctccagaatggtgactcggggggtggcagcttcagagtcagggccttgctcaggaggcagcccccactgccccacccccagcaggcctggttctccccagctaagggtcctcatgtgtacagtgggggctggcagcccggtccctgtgcagatggagggcaggggcttcatgaaacagcagagacccacaaggcacctcgggagcagagtgggggccgtggtggggagaggcggggctgggagggagtcagaaccacccctgcatctcttacggacggggaagagggtacagcttgtggggccactccatgctgctgttataaagcgtccggagtcttcaccctctagagca

SEQ ID NO: 412344 - DNA, 462 bp, Homo sapiens
  misc_feature (87)..(87): n is a, c, g, or t
  misc_feature (276)..(276): n is a, c, g, or t
tgctgcgtggaaaatgagagtagctttgaaggggcacagctttgaagggcacacagtagatgatgacatctacttcagaactctggntgctacgtggggtacgaccatgttgcattttcaggatgctttagtggaaatcaaaagcatgggatgcgaatgcaaaaccaaagggcttaggttctgcatctgacatatgtggctagctgtatgttccttgccgcgtcactcaaccttgctcagtacataccttcttcatatggcgtgcatctcttcctnagctatatgggtgtcctcgaaaatgctgagcataagaaaagtgcatttgtatcctctttatttatttattatttatttattttttgagatggggtcttactctgttgcccaagctggagtgcagtgaactgtggtcttgtcattgcactccatcctggacaagagagtgaggccctatctctttta

SEQ ID NO: 412345 - DNA, 1507 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggtgagtcctctgcgcgagcccaagggtgggcgcgggcacgcgggcagtgggtgcaggggccgcggctgtgccaccagccggagtcccgggcgcagggtagactcggggccgggggcatcggcgcggcccgcggcggcttcctggccgcaccgcctctgggccccggcggcgaaggctcttagatgtcttcagccgacgggtgaccgggcccgggggagccagggcgcggggactgaggctccgcaggtgtccgccgcggagccgcgcaggggagcggtgggaggtgcgggcgcgggggcgggctcccgcgtgtccttcccggtgagggcccga

SEQ ID NO: 412346 - DNA, 3989 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412347 - DNA, 2475 bp, Homo sapiens
aaaccgttcccaaaaaagccaaccccctgttttaaagcaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412348 - DNA, 2218 bp, Homo sapiens
acactctccagccccggcagaacagaagctgcagccacgtggacacgtcacctctgcatccaggttttccctctacagtcttggcccctgggatcatagccttgctcactttctcctgttggcccctcttgagcagaagtgacttttaaacacggcacatactgagccagcctatcattaattaattcttactgcactgttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412349 - DNA, 2349 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412350 - DNA, 1622 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagtaagtgctctcaagcacgccacggctgctcgtttcctcaggccactgagtcctgcaggctgtccccttgtcttgcttctggtgctacagccatagcccggccagatgaggtaatcaatcatagagatagaatgccaccaaggagtcccagttggaccg

SEQ ID NO: 412351 - DNA, 478 bp, Homo sapiens
ggggttctggagtttcaaagtccaaggtcaaggtgctagccaggttgatttctcctgaggcctctctcctggacttgtagatggctgcctcctccctgtgtcttcacatggtctttcccctatactagtctgtgttctaatctcctcttataaggatactagtcatattggattaagacctacccaaatggcctcattttaacttagttacctctataaaggccttatctctaaatatggtgctgtcaattctgaggtgtacgcggggttaggacttcaacctaggaattttgggaggatgctgttcaacccctaacagcctcagtaaagcttgtttcaatcatggttacaggatgtgaggagcaaaaagaccactgcagtgcttgaccctctgccaggtttctaaacggcatgggtttctgttctttttgtttttttccaccccagggagaactaatgccgacgtgatgaccgccct

SEQ ID NO: 412352 - DNA, 422 bp, Homo sapiens
tggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggct

SEQ ID NO: 412353 - DNA, 4666 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataacatctcaagctttttatttgcatttacattttcagctgtggtcagtgtaaaaattggtcatcagctgggggcggggtggttagaagtgattcaacagagctacatgctttaaacttgcccaagttctacctccttcctttgaacatttcagattggagaaccaaggagttgattgcctgaacacctgaacatccgtttatgggggccagatagaatttgttttcaaataggcttaacaggcatcattaaaatttcattctgtgtgttttgtttaggcttgaggtgcttagaagatgggataaaatattctacttttttctaaattttaactttgtttcctatgtgatttttttaaatgtcctttctaaaatattctaaaattattgattcacaagtgccatgttcagaactatagaatattactgttacataatgtctgcacagctggtcccttgattcagtggtaaggtttttgtgtacacccccctgcttgcattttatttcagaaccacaagtattacccaatatgttacatggagaggaactataaagaatccctaaggcaaaaagaagtctctagaaaatgactagaggttttttttttagcataacaaatttatttaaagaaaattattaaatttatcttcgccttgtaaaaaaacccaccaaaaaaaaaaaa

SEQ ID NO: 412354 - DNA, 3926 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412355 - DNA, 1831 bp, Homo sapiens
acccacgcgtccgcgacccacgcgtccgtggcaaagtgctgcttccaaagctcattgacttttctgctcagattgcagagggaatggcatacatcgagcggaagaactacattcaccgggacctgcgagcagctaatgttctggtctccgagtcactcatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgtttaaaaaaaaaaaaaaactaatccaacctgttagattttgcaggtgaagtcagcagcttaaaaatgtctttcccagatttcaatgatttttttccccctacctcccaaaatctgagactgttaaaacatttttcttctatgaacactgctcagacctgctagacatgccataggagtggcgtgcacatctctctctcttccagcaggaggagcccgtgagcacgcacagctgccctgtctgctcacccgaaggcaccgggctcacctggacctcccaggaaagggagaagagcctcagaaactgctctgtgtttagaaggaatatttttaagagtccagctttttcatttccacaatttcctatatccagatttgttttgacaatgtagtttggaagaactaagattctaatctctgaagaaccttatagggccttctaaaacataagagtttcctttgttgcttcaaatatttgaacattatgttaaagatcaagtattaattttagttgtactctagaaagctaaagtgccacattcggggctatttttatgattcagcaatcttttctaaattgtgtagcatgtgtatgagactatttatacccaaggatatgaaggaacataagtgactacaaggctctaataagccacggtggcaggaggttcaagcggttctgttcactaaatttttctcctgtaagctttgaatggaaacttctgtatcacatgatgtgtttcacttatgctgttgtgtatatacctaatatttctatttttgattttattttaatacacctcgtccaataaca

SEQ ID NO: 412356 - DNA, 2456 bp, Homo sapiens
caggccctctgtaaatgtttgctattaatgcaatgctgagatcccagtgaacagaatctggcttagaagaagtgggtatccacggtgcccgagcctaatcttacatcttggatttgtaagtggcatttattgagttgaacatgagcttgagcacgcggtcacacattctttcagcaaacactggttaggcaccagctgctacgtgcaagcactgccctacatgctgggacgcagctgtagtaggaatgaaataacgccagcattcctgcatgcgggcagtgcgggccctgtacagaaaggtacacgagataggcatcctcacatccattgtcctgggaggaaactgaggctttgagaaacggagaacttgccgggccatttgactctacgtcatcccctcccccatcaatgccctgaacagcctctctgtacacccttaaggaacttactttgtaatgattattaagaactcagcgagaccccgagcatcacctcggcatatcgcatcctttctctagagaacccctaatgttggaagggatcagagcgcacctcctccgctcctgggagcacccccttcctaataataccttggggatgggtcggaaggaaaggaaaggagacgcgagaggtgtagtcgatgtgcctgcgaagcccaggctcctctggagatccttccgtccgtccctacaggagaaggctggcccgggctgctccactccccggagctgcagactgagtcgccaggtttctgtgccttcaaagccctgcgcgacggccacaccaaacacccaaaccttgggcagggaccaaacggtcacttccccgccctccgggctcaatatgcaaatccgagcaccaggaagtagctgggacctctcggccgagcccagagacagccagttcctctcccgccgcgccgggccgcgctgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcaggtcctgctgggccgccccgtcgcgccccccactctgaactcaagtcaccgtggagctccgccgccccgaaactttcaccgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggtaggaaattgttcaaagcctcttttaaaacactatttaggaaattatttttagaaactattctagagctactcaaggggaaaaaagggcatatagtatgctctggtagtaaaagttttatggtttgataacaaataacaaacctcagtgattagttgtgctactaaaagtaatatagttgagtgtggtggctcacacctgtaatcctaacactttgggaggctgaggcgagaggatcacttgagtccagcagttagagaccagcctgggcaacacagcaagaccccatctctacaagaaatacaaaacttagccaggcctggcagcacatgcctatagtcccagctactctggaggctgaggtaggaagatcacctgaacccagggaagggaggctgcagtgagccgtgatcacgccactgcactctaactagcctgagtgacagagtgaggcactgtctcaaaaaaaaaagagaaaagaaaagaaaagtactgtagaaagcacacatgattgtggccagttcttaccaggctttgtttgctgagccttttgcattattatttgaataaatcctgaagttttaagacaaagaaaattaggctgggcgtggtggctcaggcctgtaatcccaatgctttgggaggccgagactgagaatcacttgaacccagcagtttgataccagcctgggcaacatagcaagagcctgtttctataagaaattaaggggtagaaagatcgtttgagcccaagaggtggaggctgcagttagctatgattgtgccactc

SEQ ID NO: 412357 - DNA, 1115 bp, Homo sapiens
cctgggtgggtaacatattaatttttgcagatatgatttatgttctctagaaattaaaccctgccaattttcctgttattctttacattcattttgcactattggcagagtttttgttgctactttaaatctttcagtgtttttcaagaactaacttgacagcatttgtcacacttttttcttgtctcagtcactaagtagcgtttgttcctgtcagtgaatttctaaacttttaacaaatcagaaaaataacactttcttttctttttttttttttttttttttttgagtgaattcttgctctgtcccccaggctggagtgcagtggcacgatcttgggttactgcaacctctgcctcccaggttcaagccattctcctgcctgagcctcctgagtaggagtagctgggattacaggtgccagccaccatgcccagacagctggggccgggtgtggtggctcacacctgtaatctcaacacttctggaggctgcggcgggcagatcacttgaggtcagcagttcgagaccagcctggcaaacatggtgaaaccctccctctactaaaaatacaaaattagccgggtgcactggtgggcgcctataatcccagcactggggaggctgaggcaggagaatcgcttgagcctgggaggcaggggttgcagtgagctgcgatcacactcccttctggacaacaaagtaagactctgtctcaaaataaataaataaacaactggagactgtgtctgtaaataaataaataataaatgacagctggaaattccttctttgaacattaaattattagttggaaatatttctataatctatattactgttgtggttgctacttggaatttttaactttttacataaagcaaaatgtaattaaaccatctctctagtatccagcaagcacaaacgcaggagagcttgctaagaatcaaatatcccctctccttgccagggctaggtcctgaggagacacagttggcttgctgacaagtctagctccatatcatattctcacttaaaacttagtctaaaaaaagtgaaaaacacatttacctatatcaagctagtgtgtctacgtatgaaattgtggacatcgt

SEQ ID NO: 412358 - DNA, 783 bp, Homo sapiens
cctgggtgggtaacatattaatttttgcagatatgatttatgttctctagaaattaaaccctgccaattttcctgttattctttacattcattttgcactattggcagagtttttgttgctactttaaatctttcagtgtttttcaagaactaacttgacagcatttgtcacacttttttcttgtctcagtcactaagtagcgtttgttcctgtcagtgaatttctaaacttttaacaaatcagaaaaataacactttcttttctttttttttttttttttttttttgagtgaattcttgctctgtcccccaggctggagtgcagtggcacgatcttgggttactgcaaccttcccttctggacaacaaagtaagactctgtctcaaaataaataaataaacaactggagactgtgtctgtaaataaataaataataaatgacagctggaaattccttctttgaacattaaattattagttggaaatatttctataatctatattactgttgtggttgctacttggaatttttaactttttacataaagcaaaatgtaattaaaccatctctctagtatccagcaagcacaaacgcaggagagcttgctaagaatcaaatatcccctctccttgccagggctaggtcctgaggagacacagttggcttgctgacaagtctagctccatatcatattctcacttaaaacttagtctaaaaaaagtgaaaaacacatttacctatatcaagctagtgtgtctacgtatgaaattgtggacatcgt

SEQ ID NO: 412359 - DNA, 415 bp, Homo sapiens
gagacagagtctcgctctgtcacccaggctggagtgcagtggcatgatctcagctcactgcaacctccgcctcccgggttcaagccattctcctgcctcagcctcccaatagctgggattacaggtgccagccaccatgcccaggtaatttttgtatttttagtagagatggggtttcaacatgttggccaggctggtcttgaactcctaacttcaggtgatccgccctccttggcctcccaaagtgctggcattacaggcgtgagccaccgggcccggccagaaaaataacattttctaaaactttattcctatgtttgaactctcaaatgtttctgaataccaacccatctgttttaagtgactactacaatggtttttggcttatgagtgtggttttcattgtctgttttat

SEQ ID NO: 412360 - DNA, 622 bp, Homo sapiens
cctcccaagtagctggatttacaggcacaagccaccatgcttggctatgagagcaaactctactgtggttcctattaggtgccagggattgccctgtgcactttatatagattaacttgcttaatcctccgccagcctgtgaggcaggtgctagcactacttccatggtgtagatgcagaaactgaggcacggggaagttaagcagcttgcccaaggccccggagccaacaagtggtgaagtcagaattgaaacccaggctgtctggcttcagattccattctcttcattcggctatacctcttcccagttgataacagtggtagctatgacatgaaaatctctgcaggcactttgcagagttcacttcctcctcacaatgcagcatggatggcactccccttgtgggagactcaccagcctgtgacaccccccagcacctgcacccaggtctccagccccaaagcccctggcaagatctttctcagccccatgctaaaaacagtcacatgcctgctgcacgctggggaaaaggcgaggttgtggggtggctcagtgtgctgcgaatatccaaaataacccatggtgaccccaggaatctggggccacagtgaaggctaccc

SEQ ID NO: 412361 - DNA, 689 bp, Homo sapiens
tgtatggaccgcagttttcatgccgctataattgaaacacactagacggaaggaacaggatagaaagcccagaaagaaacctaaacatttatggtcaattttcaacaaaggtattaagaatgcacaatggggaaaagacagtcttgtcaataaatggggttgggaaaactgactatccacgggcagaagaatgaagttggatccttaccttacatcatattaaaaaatcaactcaaaatggattgaaaacttaaatataaaacctgaaactgcaaaactactagaagaaaacataggggaaaagctccacacttctttgggcaatgattctttgaatatgaccctgtaagcacaggtaacaaaagcaaaaatagacaaatggtatggcaccaaactaaaaagctgctgcacagcaaaggaaactattaacaaagtgaagagacaactcacagaaattgagaaaatatctgtaaactatacatctgataaggggttaatatccaaatatgtaaggaaatcaaataactcgaaaaaaaaaacctgtaaggaaatcaaacaactcaacaagcaagaaaacaacccaatttaaaaatgagcaaaggaactaaacgaacatttctcaaaagacgacataaaaatggcaaacaagtacatgaaaaaatgctcagcatcactaatcattagagaaa

SEQ ID NO: 412362 - DNA, 460 bp, Homo sapiens
caattggtttgtggaaactcgagctgcagaactccaagaagtaggaggagggtgggagagacaagcagggcctttatctagggaaggtcagcaaaacttttgaatttctgtatttctcctaaacgtgaaaaatgaggaaagaaaattgaaggggagaagggaaacatgaaataaaaagaattaatgaggattgagccccttatgtgccagcccaataagaggtgctttacccacattactgcatttaatcctcacaacggagtgaggcaaatctgttgcctctccaggagtcagtttcctcaccttccatccctcctgtcccagcccatgtcacatgataacagttaaatgctagagacccactttgccttcatgttaacaaatgaccaagggacccagttctgactatgggacataacgctaagtctgttggggggatttggaaaacagttttccttca

SEQ ID NO: 412363 - DNA, 444 bp, Homo sapiens
tctaccaaatgagacctactagaagtgtggtggtgtggaatcctgcaaatgatcacaaagaaagaaaagcccttcttctccattggatatagtcgtgcttgggtggcttggcagccatcctgctcccagctggaagacaagcaacacacagaggccacgttagatttgatcagatctggacgaagaagcataaagtcgtctttagcaagatttcagattaggaaggagagtgtgtgtagccagccacagcaaagaaagcagttatcttggttaagaatcaaattcttcatcagagaggaaatcagtgcattgactcctaattctaatattagattcagagactttattattttttagcagtttgcaaaaaatggaagtaaagtaaatatttttcatgtgtttgggatcaaatgttagggtaaattaaaactttgcacattactt

SEQ ID NO: 412364 - DNA, 525 bp, Homo sapiens
tcttgctctgtcgtccaggacgatcttggctcactgcaacctccaccttccaggttcaagcgattctctcacctcagcctcctgagtagctgggactacaggagcctaccaccacgcttggctaattttcattttttttgttgttgtttttattttgtagagatggggtttcaccatgttgaccaggctggcctaaaacccctgatctcaagtaatctgcctgcctcggcctccaaagtgctggaattacaggcgtaagccactgtgccaggcccatttcatgctattctttaaatttacttcctttgtaaatgaagacactattaatcagtttaattttaatgtgtccaatagaaactaaatgctaactatcgattgcatgcttaattacttttacctttgtcttaactctactgttccttacctaactttttataactactttctgcatttttgcatcttcattttccacccatttttgaataataaaagaaaataacaataaagcattaaaattatttttaa

SEQ ID NO: 412365 - DNA, 790 bp, Homo sapiens
  misc_feature (532)..(532): n is a, c, g, or t
  misc_feature (618)..(618): n is a, c, g, or t
tcttgctctgtcgtccaggacgatcttggctcactgcaacctccaccttccaggttcaagcgattctctcacctcagcctcctgagtagctgggactacaggagcctaccaccacgcttggctaattttcattttttttgttgttgtttttattttgtagagatggggtttcaccatgttgaccaggctggcctaaaacccctgatctcaagtaatctgcctgcctcggcctccaaagtgctggaattacaggcgtaagccactgtgccaggcccatttcatgctattctttaaatttacttcctttgtaaatgaagacactattaatcagtttaattttaatgtgtccaatagaaactaaatgctaactatcgattgcatgcttaattacttttacctttgtcttaactctactgttccttacctaactttttataactactttctgcatttttgcatcttcattttccacccatttttgaataataaaagaaaataacaataaagcattaaaattatttttaaaaaaaanaaatctattttaataattaataaacaaatttttaacctattttttctattccttttattcccttcaacctccaacggacgacaaantttatgggccctctgggcccctccggggggagcttttgggcccttctttctttggtggggggttatatagggagtctgctactttcccactcggccctgatactttcggttgcgcgggcgggttttctattcttctcaggggtggaatacggttttcccacaatatcgggat

SEQ ID NO: 412366 - DNA, 418 bp, Homo sapiens
tcttgctctgtcgtccaggacgatcttggctcactgcaacctccaccttccagagatggggtttcaccatgttgaccaggctggcctaaaacccctgatctcaagtaatctgcctgcctcggcctccaaagtgctggaattacaggcgtaagccactgtgccaggcccatttcatgctattctttaaatttacttcctttgtaaatgaagacactattaatcagtttaattttaatgtgtccaatagaaactaaatgctaactatcgattgcatgcttaattacttttacctttgtcttaactctactgttccttacctaactttttataactactttctgcatttttgcatcttcattttccacccatttttgaataataaaagaaaataacaataaagcattaaaattatttttaa

SEQ ID NO: 412367 - DNA, 489 bp, Homo sapiens
caggacagcatgggttttgtgtatgtttattcttttcccacgattgagagaaattgctccatctatacattttatatgaatgaaattatatttcaataaatatggttggaatagattaatgaataagcttcttaatgtgataactttagaaggaaacattttatgtatatagaaattattgtaaatttacatactgatttaataggaaacttaagatctttttaagtatttaataaatatttattgaatgtgaaccagatttatgttccatgtgaataagacccaataagatggtcatttggtagtatagtcttccctcagtatatgcaagggattggttccagcaccacactcctgtcaccaaatctactcataccgaagtcctgcagtcagccctgtgaaactcacatatacaagaagtcagctttctgtatacttgagtttctcatccctccctatcaatagagtactttttatttgtgtttagtt

SEQ ID NO: 412368 - DNA, 498 bp, Homo sapiens
cggccacttcactggtggaaatgccgtctgccaatagacttgctgtcctaaccctcgtttaggacttctcatttactgcagatattggtacacataggtagtgggcggctgcctgagagagaccatttggtacttcttttcttatctcaaagctgcttcagtcttgtgtgcacaggggatgctcagaagcgtgccttctttcagggagactggccatgcgcctgagttagatgataacatggaggttcatcacacgctgtctacttgagtgtgtttttggaattctccataataaaaagttaaaaaatacaattgataggtaagagtaattgaagtagtttcaaattggttagctataaaatgcaactatgaagaggattgtaggtaattaaaatactaagattgtattgaggagaaatatattattcagaacaatacctgtgacatggcattagtgacaaatatgaccaataaactgattaccttatgtgactatgt

SEQ ID NO: 412369 - DNA, 437 bp, Homo sapiens
cgccaagatccaggccatggaggctaacgtgcagctgagctttgacaagcactgtgatccaaagcagcctaattactggccggtcatccccccgaagttctgagctcggggcacagggcacccagcctcttcctcttccttttggatacgcgctcttcatctctccttctgtacatttctcagggaaaggggactttgtactgaggtacaggcacgttcaccacagtcccagtgggcctgtcacggggtggatgtactgtgccagccacttggaggtcggcaggacatattctgttgccaacatgataaattttatcctgacataaaatgataattttgtatatattatactggttttttatgttgtcagtaacagttcaattcattaaagttcttgcctagagaaaaaaaaaagaattctaaaacatgaacgatga

SEQ ID NO: 412370 - DNA, 173 bp, Homo sapiens
tagaaattgggaatttattgaatattgggaatttattgaatcttcactttatcaaatggattattctccactcagaaaaatgtgaaaagagtgtgactttggaatccaaagcattcctgttttttggtggcaaccaactttcaaaggctgtatttaccagttaataaatacca

SEQ ID NO: 412371 - DNA, 174 bp, Homo sapiens
attttctttccttgtagctcagcccagctctccagctctatgtattaaacagtagcagtaataactagcattcttgccttgttcctcaccttaaaaggcatgtattatataaaacttttctccactagcaatattttctgtaggtttttggtattaaaaatccctactaaatta

SEQ ID NO: 412372 - DNA, 1607 bp, Homo sapiens
ctcacctgccccacagccgcaccctgcctgtgcctgcaccctggggagcccagagccggcaggggccgaggcggtgggacctcgggggagctcaagcctcgactgtcccctcgctggaggccagaggccaagatgatgtccttgctgggcggcttgcagagatacttccgggtcatcctcctcctcctcctggccctgactctgctcctgctggccggattcctgcactcggacttagagctggacacacccctgtttgggggccaggctgaggggccgccggtcaccaacatcatgttcctgaagacgcacaagacggccagcagcacggtgctcaacatcctctaccgcttcgccgagacccacaacctgtccgtggcgctgcccgccggctcacgcgtccacctgggctacccctggctcttcctggcgcgctacgtggaaggcgtggggtcgcagcagcgcttcaacatcatgtgcaaccacctgaggttcaacctgcctcaggtgcagaaagtcatgcccaacgacaccttctacttctccatcctgaggaaccccgtgttccagctggagtcctccttcatctactacaaaacctacgcccccgccttccggggcgccccgagcctggacgcgttcctggcctcgccgcggacgttctacaacgacagccgccacctcaggaacgtctacgccaagaacaacatgtggttcgacttcggcttcgaccccaacgcgcagtgcgaggagggctacgtgcgcgcgcgcatcgccgaggtggagcggcgcttccggctggtgctcatcgccgagcacctggacgagtccctggtgctgctgcggcgccggctgcgctgggcgctggacgacgtggtggccttcaggctcaactcccgcagcgcgcgctccgtggcccgcctgtcgcccgagacccgggagcgcgcgcggagctggtgcgcgctggactggcgcctgtacgagcatttcaaccgcaccctctgggcgcagctgcgcgccgagctggggccgcggcggctgcgcggggaggtggagcggctgcgcgcccggaggcgcgaactcgcgagcctgtgcctgcaggacggcggcgcgctcaagaaccacacgcagatcagagacccgcgcctgcgcccctaccagtccggcaaggccgacatcctgggttacaacctccggccgggcctggacaaccagacgctgggcgtgtgccagaggcttgtgatgcctgagctccagtacatggcccgcctgtacgccctgcagttcccggagaagcccctcaagaacatcccgttcctgggggcgtagaggggccgggccggggacgaggcctcctgcggacaccagctcctctctccgccgtcaccggggaggccgaggatccttgcagggcttctggggcgttgggaaacccaggcccgccggccacgactctgccctcagcttcacagtcaccgaagaaatgaagttacaggaggggcacaccgtccttttgtctctgcctttgaggttggcgggaactgaaactggtacggtctttttgaatagaaatttggggtctttctggcgacgtaaaactgtgtgta

SEQ ID NO: 412373 - DNA, 518 bp, Homo sapiens
tggatcccactttgggaacagagggcttattcctgcagctgctagcagtactgctgctgctggaaagctgccctcagtgtcagtccccttcaagaaccccctcagcaagggtcaactccattaaagttatgcctcttcttgggggaggccacatgcaataaccatttggcttagaagtgtaaaaaagcccacgggtcatgaaggcctgaccctcgtggctgaacatggggtggcttggaatggccaacccatcttaaaactctccatgagggtggctaatgcttccattgaaatttctccctctgctcaatcctgcttcctttctttccctttctttctcttccatgggagttgatcccaagatcagtccctaatcaacattcagaatgctgatctccatttcagagtcagctccagcagtcagctgcaaaatctcagctcagcatcttcccatgtggcttgtcttccgtttcaattgttcaaataaataagaggtctggctactgaactgtactcat

SEQ ID NO: 412374 - DNA, 301 bp, Homo sapiens
agattggtcagtgggtacaaagttacaattaggtaggtgggataagttctggtgtcctattgcacagtaggatgactgtagttgtatatttcaaaatagctagaagagaggattttgaatgtttttactacaaagaaaagataaatgtttgagatgatgggaatgctaattaccctgatttgatcattgcacaatgtatacatgtattgaaatatcacattgtaccccataaatatgtacaattgtgtgtcagttaaatttttttaaataaaataaatatttttagacctttctatataca

SEQ ID NO: 412375 - DNA, 578 bp, Homo sapiens
gggtacaggaagaatgtcgaactgcaaaaggtgacatagaaatcagtctttatacagttgaaaagaagaaaaagccatcttacactactcaaaggaatgattatgagcctagctgtgggcgttctttacgcaggacacagcgcaaacgtcagcatacttaccaaacacggtccaacatagagcataattcacaggcatcatgtcaaaattcaggtgtacaggaagactcagacagttcttcagaggaagatgaaactgttggcacaagtgacgcttcggtagaggatcctgttgttgaatggcaaagtgaaagttcttccagtgactcatcaagtgaatattctgattggacagcagatgctggaataaatttacaacccccaaaaagacaaaccagacagacaacacgtaaaatatgcagcagctctgatgaggaaaatttgaagtccctagaagaaaggcagaagaaacctaagcagactagaaagaagaaaggaggactggtttctatagcaggtgagcctaatgaagaatggtttgcccctcagtggatcttggatactataccccgacgttcc

SEQ ID NO: 412376 - DNA, 259 bp, Homo sapiens
caaaaaccatgtaaatgtgaaaagcctattttttttttgtgggggttggaataaaaaacttgaacacttcctctaaaatatttcatcataaaaatcatgtgaaatgtatattatccccattttaaatcccaatgctcaggtaaacaatttgcctgtatgtatatataatatatataaaatacatatatacatgttatatataagtccatttgtttacaagtatgttacatatacaaataaataaaaagtagtacaagtg

SEQ ID NO: 412377 - DNA, 513 bp, Homo sapiens
ttttttttaatcacatgcttttcattttccaggcacattacttttttaaaaaatcacatttcttctttgtatagttgaagcaagtaatttattctaagtgatcagaataattcaattgttggcaaaagtatctgagactttattacaatcatttctataattaacatttttatatgaaagtcaaattgcctcagagatttatatcatttattgtgtacttactctttatcagatactgttctaaatatcttaaatgcattatctccttcaatctttacattctgaatagtaggtgctattatgatccccatcttcaagttaaggaaacttagtcactctctcaagttgtacagctaaaacacatgataaagttgaaatattaacaaataatttgtctcccacacctgtaccttcaatttttgttactcaatttgtggcctatggaaaccagtccctctatcctcatacccccataactcaatcagggagataaattgaaatgaaaaaaaaata

SEQ ID NO: 412378 - DNA, 290 bp, Homo sapiens
ctcacttaattgaaaaataactgccaagttcaaaactataattagaaaaaagtattctaggcattatgtttcaagagcttcaattgcactggaacttgcattaaaattagaatcaaagcaaacttaagaaaatagaacaaaacctgaaataagatagctacatgtacatgaacatatctatattaatttgttgggggaagagttcagtagccctaacttttcctaaagttgtctttgtttatatggcaatttaaaacgctggcactgttgaagtaaaacatacacattta

SEQ ID NO: 412379 - DNA, 467 bp, Homo sapiens
tctctgacctcttctaccactcagtcccatctcattccattctaaccacattgacctacttactgtaccacagacataccaggcaccctccttggggcctttgcactcacttagaatgctttgggtctaccttgaccacagtctttaaaattgcaacattaaaccccaccttggcactcttttttttcccctcttggtctaatttttgctttttatgctaatatttatcacctaacatcttatggaatttacttatgttcattattccttttctgtccccattagaatataagctccctgagggcaggaacttttgatgttttatttactgaagtatgccaagtgcctaaaactgcttggcacatattagggggctctataaatatttgctcaatctttttttttctttaagagacaaggtccagcctgagtggcagagcagcaaagtgagggacacactgtctcca

SEQ ID NO: 412380 - DNA, 654 bp, Homo sapiens
tctctgacctcttctaccactcagtcccatctcattccattctaaccacattgacctacttactgtaccacagacataccaggcaccctccttggggcctttgcactcacttagaatgctttgggtctaccttgaccacagtctttaaaattgcaacattaaaccccaccttggcactcttttttttcccctcttggtctaatttttgctttttatgctaatatttatcacctaacatcttatggaatttacttatgttcattattccttttctgtccccattagaatataagctccctgagggcaggaacttttgatgttttatttactgaagtatgccaagtgcctaaaactgcttggcacatattagggggctctataaatatttgctcaatctttttttttctttaagagacaaggtcttgctgagcccagggtggagtgcagtggcacaatcatagctcactgcagcctcgaccttctgggctcaagctgttcttcacttcagcctccagagtagcaggattacagtgttgagccaccacaaccagcttgctcaagaatttaatgacccatagtaaaggcctacagtatttaaaaaagaaagaaaaaggaaaaaaggaaggaaggaaagagggagggagaaaaaaagag

SEQ ID NO: 412381 - DNA, 444 bp, Homo sapiens
tttcagtgactttggcattcatggagtcagtgggaagatggtaattcctttttgcaatttggagaaactgagacacattttattccttaagatttcattcgacaaatagcaagatgaaatattctttgaaaaataaaacttgtgcctaaacatacacacttaattcttcaccatcacataggagtcttttgagacactacacttatttcagtgatgctaccattagcaaaacttcgttgcatttccatttgaaattgtcttaagagcctgtggcacaatgttagtgatggcaagtgttcatcttttgaaggagtgtttccttgcttgaagggccagaagttgtttggaacaaatccatgtgatgaagggaggtgggtggaggttggatgccatatttggctctactatttttggttgaaaatgtttcatgatcaacacctgtga

SEQ ID NO: 412382 - DNA, 354 bp, Homo sapiens
gcatgagccaccatgcctggctgaacgttcaagaagaagtttgtgcatcaattttttaaaaattgtgatgtcaaaagatagctgtgtcctacacttggaaagatacaaaaactgcacattctggcaggtagttttgcttgctggtgcttgagatagagccatacattgatctcagtggatttatggagaaaaatagatagagaaagttatttctaaataagaccaaaaagtccttttcttaagcagtgacaggtaaagaggttgtcttggttaaccttgaaatgtgttgcccttgattaagacagttttatggtggggatggtagtggtgataaacttgtttgaaatttgtcca

SEQ ID NO: 412383 - DNA, 659 bp, Homo sapiens
gcctactactactaaattcgcggccgcgtcgacgattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagttaagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctgtggactatctcccgggtc

SEQ ID NO: 412384 - DNA, 829 bp, Homo sapiens
gatgaaaatcaggaattccagaagaagttcatggaaaccacaatgaataagaagggggatttcttgctgcagaatgaagagtcatctgttcaatactgccaggctaaactcaatgagctctcaaagggactaatggaaagtatctcagcaggaagtttctctgttcctggagggcacaagctctacatggaaacaaaggaaaggattgaacaggactattggcaagttcccaggaaaggagtaaaggcaaaagaggtcttccagaggttcctggagtcacagatggtgatagaggaatccatcttgcagtcagataaagccctcactgatagagagaaggcagtagcagtggatcgggccaagaaggaggcagctgagaaggaacaggaacttttaaaacagaaattacaggagcagcagcaacagatggaggctcaagttaagagtcgcaaggaaaacatagcccaactgaaggagaagctgcagatggagagagaacacctactgagagagcagattatgatgttggagcacacgcagaaggtccaaaatgattggcttcatgaaggatttaagaagaagtatgaggagatgaatgcagagataagtcaatttaaacgtatgattgatactacaaaaaatgatgatactccctggattgcacgaaccttggacaaccttgccgatgagctaactgcaatattgtctgctcctgctaaattaattggtcatggtgtcaaaggtgtgagctcactctttaaaaagcataagctccccttttaaggatattatagattgtacatatatgctgtggactatctcccgggtc

SEQ ID NO: 412385 - DNA, 197 bp, Homo sapiens
tgccttgtctggagaatgcagtgataactctggcccagcgtgagaactcagcggccgtgcagagggcagctgactactacagccagcagatggcccagcgagtgaagctccccacagacacgctccaggagctgctggacatgcatgcggcctgtgagagggaagccattgcaatcttcatggagcactccttcaag

SEQ ID NO: 412386 - DNA, 886 bp, Homo sapiens
gaagactgcgcgtttgagtgtccctggcaacgccacgcttccgccttctggaagcctgcactccagcttcgagtggaacgatgcctctggaggtggtggtggagctgcagatccgggcgatttcttgcccaggagtgttcctgcctggcaaacaagatgtgtacctcggggtctacctcatgaatcagtacctggagaccaacagctttccctctgcgttccccattatgattcaggagagcatgagatttgaaaaggtatttgaaagtgcagtagatcctggagctgtagtagaccttttggaaatgtgggatgagttggcctactacgaagaaaacacacgagattttcttttcccagagcccaagctgacaccttcgcaccctaggaggtgtagggaggtgctcatgaagacggctctgggttttccaggcattgctcccaaaatagagttttctacaaggacagccatcagagaatgtgtgtttctgcatagaaacagatttcttggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcc

SEQ ID NO: 412387 - DNA, 520 bp, Homo sapiens
ggcacgagggtgggactggggaagcttctgggaacatttgctctaggtattcagctaaactaagaggcattgctcccaaaatagagttttctacaaggacagccatcagagaatgtgtgtttctgcatagaaacagatttcttggctggggaaacaaagggaagatgttggttcagcaagaacacagaagcttaaagaagaaactgaacagaaatgggacccagacctctggagaagggctgctttcctggatgcttcttcaggaattcgaaggaagaaagacatgagtcacggaggcctttatctacatcacatgaaccaatatttcccttaaatactataaagatgaaactaaaggagaataatctcaacagactgcccaaaggcatgcaagcccgggcgccctctcaatattctaccaggcatttcttccaggaccagccagctcagttgaaccttggaaataatttcaaaatctctggaggaagcaagcctccatttgttgttagacacgtgagcc

SEQ ID NO: 412388 - DNA, 485 bp, Homo sapiens
atgatacaaagatgtacactgaggtgtgtcactcccatacctgtcccgacctagatgtttccccacctaccccggtgaatcatcgtgtttttcagttacttggtttcccttctagtgtcagtctgcacaaatacaagcagatgcaaacatgcagtcttatttaccctccttaactttacaaaaaagaagcctgccttgccttctccacctaatatactggagatctattcacaggggtgcagggcatacttgtggtttctctcagcagcagagcattccattttgtgcatatatcttagtgtattaaccagtctcccactgaagaacacgtgggttatttctaacgtattactatcaaaaacaatgctgcaatttgtatgtgggcaggtgtattggtaagataaattcctagaagtagaatttctgggtcaaaggtaacacgcatttataacgccaatttgccttccataaaggttgtaccgttt

SEQ ID NO: 412389 - DNA, 839 bp, Homo sapiens
accaaggaggccatgagcgctggcctgactctagctgaagaccaccatggaagtgacctgtctcacagacccatttttaccctgtggggtttctttgggacctgactgtcaagagaatgggttgggaacttggagaggaagagctcccgagtaactgtgtgtgactttgggaaagtcatttagccttcctgagtcagtttcatcttggaaatgaaggttgaattaagtaacctccaagatctcttccagttttcccatcatatcacactacattcgggaaagtcctcttctacctttggccaaatatggtttagactcatcctttctccactgacccactcccgctccacagcaacttctggctctctgacccccgaccaagtactcacatgctgacctggagacaccaggcacacccagggaggagccacagctgagtcagatctgatccttccctcagcccagccaggctttgaggtccatgactcctttatgtgccttcaacagataaagtattctagccttggcttttattgtatgtaagctctgtgttcccttcacatgcctgtttactcactttttctcatgccagggagactaaactcctcatgacagtgtttctttaggggtggtctctggattagtaatatcagcatgccctgggaacctgttagaaatgcaggtgccagcctgggcaacttagtgagaccctgtctctacaaaaatttaaaaatgcaaggcggcacatacctgtagtcccagctacttgggaggctgaggcaggagaatcacttgaacccgagaggctgaggttgccatgaggctgcagcaagccaaga

SEQ ID NO: 412390 - DNA, 357 bp, Homo sapiens
cagctttaaggaagatacaggactgatgccaatactgcatggctggtgactcctgggctcagcctctgaatatctccctgtcactccccaggaagggtgagcaggtggtcacgggaggaggctgagagcatggagagaaactcagctaagggagtcatttgctctggggtcgcctcagcttttgtctttgctctcatctcagccactgcagggtatgtgggctgcgcccgtgccggatcagctatgcgcatcaaagccccttactcacgactgctcggcagtggaggcagtgaagcacaggcactcggtccatccagtcctcagtgtgttcttgtcctatgttcagtatacccccat

SEQ ID NO: 412391 - DNA, 593 bp, Homo sapiens
atagcccttctttcctgcagaggctgtgagaagctctgccgagcatttgagagttaaccattatttacggagcaagacctgcgtgaggcactgattgtactaacttacaaaaattgtgtaagagattcttttgacatcaaaggtacttacggtccagaggggaaatcacatacgtgaattcggaagcccattcaagactgcaagagaaaattcgaagataaacaaaacagttcatgttttgagttctgtttctttagatttctatgtgggattggtggcttgagtgaccaagtagctggcatcccaaccatttatagacatgttctattttgaggttgagtttgtggtttggggaggatgtgtaatcattttcaacaaatgcttactgagtgtgcaaagtattcctgtggaaggcacagggagtaccaagaagtataaagttacattccccagcttccaaggagcttctcatatctgggagggcaaggcatgtttaagattttaaaatcttagtaagattataagtcttaagaaaaaagcataatcatccacatttattagaaatatatactgaactattaaactgtctaaga

SEQ ID NO: 412392 - DNA, 260 bp, Homo sapiens
acactggattgtattatagtactatagaatcaaactcaagtttgattgaccataaccatatatttactgaaaacttcacttagaattccaacttggaatgttaagaaacatatcggctgggcgcggtggctcatgcctgtaatcccagcactttggaggctgaggcaggagaatcgcttgaacccgggtggcggaggttgcagtgagcgtagatcacaccagtgcactccagcctgggcgacagagccagactccatctc

SEQ ID NO: 412393 - DNA, 348 bp, Homo sapiens
acagtttgtccctctttattgtgactgtgatatcccattatatgaatgcaccatagtttgttgagggatgttaatttctaatttttgatgatacaaataaagttgttatgaatgtgtgtgaacttaggttttcattttatgtgagtaaacggctaggaatggcattgctgggtcgtatggcacgtatatgtacaactttgtaagaaactgtcaaaccatttccaaaatgactgtattattttgcatttccactagatgctctgcatccttgctagcaactgtactgttttaaaaaaatttttagctattctaaaagatgcatagtgatattttattgtgcagtgtctg

SEQ ID NO: 412394 - DNA, 443 bp, Homo sapiens
gcgggcaaggcgcacatgaccccgggaatgagccacagacaatggcagacggcccagagagtcgggaatgctcagtgcctgtcggttccaacggaaaaggagcacagcagcttccagaccacctccctcctcacagaagtacctgaactggaggagcatcaggaccctggcaaggcacctgcccagctgctgcgatctctgccatccgcttctccatctgctccagtcgctctagtatggacatccggaactggttgtctgagggggaacgggtatgggaggctgagtgggcagtctaggtgatgccctgaacaccaaaagtagacctgtcccaagatctggggatgaggacacagaaccatattcttttatcttccccaaaacaacagctcctttaccccttcacctaaataaagcccaccaggactcagtccttaaactag

SEQ ID NO: 412395 - DNA, 403 bp, Homo sapiens
tacacacaatatccacttgaaacccctttaaacttagttgggggaatacataccactgatttttggacccataatttgatgatttacagataattcttttgggaattaaatgtgtgtgaaagtgaaataactggagaacaaatgagggtcagagatagggatcaatcctataccagaaatttttttcctgcttcaataagggctagaaggtagtgccctatgtaggtctaggatttctttcttccttccttccttcctttctttttcttttgttccctccctccctccctctctctctctttccctcccttccttccttcctttctttttcctttcctttcctttcctttctttcttttgtgtgtgtgtgtgtgtgtgcgagtttgagtctcactctgtcacc

SEQ ID NO: 412396 - DNA, 270 bp, Homo sapiens
gacagagtcttgccttgtcgcccaggctggagtgcagtggcacaatcacagctccctgcaacgtccacctcccaggttcaagcaattctcataccttggcctcccaagtagctgggattacaggcaattccacttttgatttaactttgtcaggagttccttgaccactgtcagaattgatgactcattagaaaaactaaaaacacttagaaaaactgttacatttatggctacaatttattaaatagaaaagatacagattatatttag

SEQ ID NO: 412397 - DNA, 749 bp, Homo sapiens
aggacaggattgcttaggaatcacagatccaggtggggtcagtcaggtgccagaatgcaaaagtctgaaaaacatctcaaaagaccaatcttaggttctacaatagtgatgtatagtgttatctataggagcaattgcagaaatcacaaatcttgtgacctctggccacacgactcctgagcagcaagggattatagagaaacaagctagtggacatttgctggctgtcatttagctatacctacattttagcagaattcaggcccctcccgtaatcctaatcttgtagtctgcacttagtcttacaaagccagtttcagtccctgaacaggaaggggatcagttttagggagggactattatcatccttgctttaaagttaaaccataaactaaattccttgcctgcacctaagaatgagcgagggcagcccacctgcagggctagaagccaagatggagtctgccatgtcaagcttctcttcctgtcatattctttgcaaaggcagtttcaaaacattgatatttggaggtccacctaccaaaaagatgactggaggcccaatccccctagatggtagttccccacccaacaggccccttctatgcatatgagcctctggtccatttcttaatgctttgcaattaaatatgaccagtgataagagaaaatcctgttttcccaacactcacacacagaacttaatgcgatgaacaataattcaaacccttatttcccaaagcaaaacc

SEQ ID NO: 412398 - DNA, 574 bp, Homo sapiens
tgtaaggacactccacagagatcttatttttaagaatattgacattaaggatgggaaactatggtgggaacaagagctatacaataactctgtatataatagtcttagaggatatttcataccttgctggagaaccgtaatatgccactcctctgctcaaactcctgcactggctcccctctgacccagaaaaaaagccaaaatccttctcacagcttccaaaggccctgcaaactctaacccacccgtcattacctctttgccttcatctccgacaaccttctcccttctgtactgggcttcaggcacactggcactcactctgtttcttgaaccccaagcatgctctggcctaagggcctttgcactgactgtcccttctccccggaattctcctctcccagagatctacacggctggttgcgtaattcctgccaatctttattcaacagtcagcttctcaatgagcccttcccaggctaccctttctgaaatattaatctccccacccaccccaacactgaatagtatgtctttcctacttttctgtttagcatgctctgtgttgatctta

SEQ ID NO: 412399 - DNA, 388 bp, Homo sapiens
actcatactggagagaaaccttacaaatgtcatgactgtggcaaggtcttcagtcaagcttcatcctatgcaaaacataggagaattcatacaggagagaaacctcacatgtgtgatgattgtggcaaagcctttacttcatgttcacacctcattagacatcagagaatccctactggacagaaatcttacaaatgtcagaagtgtggcaaggtcttgagtccgaggtcactccttgcagaacatcagaaaattcatttttgagataactgttcccaatgcagtgagtatagcaaaccatcaagcattaattgacactagagtcagtccagcattgacttgagtttgtgttgacttaacattgagttcaacccttaattgacattca

SEQ ID NO: 412400 - DNA, 384 bp, Homo sapiens
tacttttttccctcctattcaaaaagtcttcaaagcctttttctcacagcccatgcattaatgtgaaacacagggacgggtatccattgttgaggctctgctagctgggaagagctatgccaggtgtcttagcacatctcagtgagcctcaaaacaactttttaagcttcaatttacaaactaaaataaataaataaataaataaagctcaaagcatcttagcagccaaagtcacacagataattagtaaatactgaaacttatatttgaaccctgctctctgagactccagatctgtgcttataataatcactctatcacagtgatcttttagttattttcaaggtgttaatgttttattatgaaatattttagacagacaag

SEQ ID NO: 412401 - DNA, 223 bp, Homo sapiens
ccaagcccagctgaaatcaattgattctaatagatttctaataattaggaaatagttactgtgcatctaggatgtgtaagaacaagcaggcaaggtgctgtgctgagagaagccaagtgagataagatagaggcccagccctcacttacatccaaattcttcagacaaaaatgtttacaggtaaattctcaaccttatggggtaaaagaaccagtcattattg

SEQ ID NO: 412402 - DNA, 399 bp, Homo sapiens
tacacccatccctttattcctcctctttcctcccaattccctttcaagaatcgacaaaacgtcacactccaccttgaatggtcctcaaaggaggactgctttccaggctccttggagccactcctcggctactcagcaacttctcaggttccagcgcacactgcagtggagctgacttgagggcacgtgctccgacaaaggagcagagcctctgacagagagctggcctttcacggcacaccccctaagacctctgcatcctgcggtgacccctgtgccacatatgcctttcatccatttcccttctcagtaactaacattaatcatctctctggaggacaggtgtgggatttggattttatctactgatctcttccggggacttgtagagaaaagcag

SEQ ID NO: 412403 - DNA, 388 bp, Homo sapiens
tccatctcaaaaaaaaaaaaaaaaaaagtgatagagttgaacaatcttaagctctggttcatctagaagtgatccaaagtagaggtaatgactcctggcagttggtgtttccctgaagggttaatactactgctccggagcctcatcttgatgtggaaactcctaaaaacccatctactcagcagagcacttgcctatggaattctctaatatgagacgtgtcatttatggatttcaaaaaattacatatgatctttgtggatttatgtgcaatggtggcagagggacaaaataccaattaagtcagggcagagtcacagtgacaagaaaactctcagaaactagttctaacctgacttggaaacaataaacaggttatgaaacatta

SEQ ID NO: 412404 - DNA, 147 bp, Homo sapiens
gagcaaattctggcaacatctgcctcattcttaaaatctaaagcaggaattagcaagctataccacctgtgagtcaaatcagcccactgcctgcttttttgtagatgtaagctaagaatattttcagcatttttaaagtattgttta

SEQ ID NO: 412405 - DNA, 434 bp, Homo sapiens
ccctccaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtgatcttcgtgaggtgagcctcacctcctctgcccaaggagaggccagggaggatcctctccttgacaagcctactgcacagccgatcgtgcaggaccaccaggagcacccaggcttgggcagcaactgctgtgtgccattattttgttgggcttggctgccaagaagaaggagataaacatcaccatcatcaaacagctgctcaagaaatttttaaataagaaaccaagttatggggttaatctcctacacaattcatttacttcctttga

SEQ ID NO: 412406 - DNA, 338 bp, Homo sapiens
tagagtggtagaatagtaaaccacccaccctcttcccccagagatgtctacgtcttaattcctggaacctgagaatatgttagaccacgtagcaatgggaaattaaggctgcagatggaaataaggttgaaaatcagcagaccttaaaaacagtgaaattatcctggattatccagttaggtccaatataatcacaaaggtccttaagtagaaaagagaggcagaagaagaaagtcagaggaagagataagactaagcaagcaacatcagaatgatgtgcagtgagaaggagtccgcctgccattgctggctttgaagttttgaagacaggaagggag

SEQ ID NO: 412407 - DNA, 488 bp, Homo sapiens
atccatgaggcatgatcaggtacacatgggccaataggaatgtgaacattaatctcgtccttctggaatctcagaaaaaccaagcagggaggcctggtctcaggtcataggcatcacagctagcatagatactgaggaagaacagtttgcatccaggcagagggtgaactggggccaccagcacaaccctcagcacacaggtgccccacacttcagggatgccccaggaacacacgcatgggggcatggaggggacaacttctcgcccaagaccacaagaggtctggctgtcccagggctcttttgtggtcatccttccacatgagaacttaaaaaggcttccacgggcgcggtggtgtgcacctgtaatcccagctactcgggaggctgaggcaggagaatcgctcaaacctgggaggcggaggttgcaatgagctgagatcacgccactgcactccagcctcggtgacagagcaagactccgtctc

SEQ ID NO: 412408 - DNA, 443 bp, Homo sapiens
tcaaaaaggcgtcggcgtccggaccgactggagggtggggctggcatgtgggggctgggcgggccttgcgcgcgctccccgcgtgggatgaccggaatgcacgtgccttggttgcagagtgagcccctcagccccgaatctggagtggccgcggccgggaaacaggaacccgggtttattattagccgtcggggaagaggggccggcagcagttccaacagtgtgataacacacggaaaacggaaatccaagggatctagcaaaaggattccacccagcaaaaacgccagcttgggagagggcccctacctaactccttccttctggcctccacccctcccctgatacgtttccttccgtctagtctcgagataacccttcatcccccagtttcttgactctggccgctgttcttgaacatttcttaaacactttcagagaaa

SEQ ID NO: 412409 - DNA, 286 bp, Homo sapiens
tcaaaaaggcgtcggcgtccggaccgactggagggtggggctggcatgtgggggctgggcgggccttgcgcgcgctccccgcgtgggatgaccggaatgcacgtgccttggttgcagagtgagcccctcagccccgaatctggagtggccgcggccgggaaacaggaacccgggtttattattagccgtcggggaagaggggccggcagcaggtacaactccatcctgggactcttacgtaataaagggtgaccgggcatgctgggtgcacgtggacgcgcggtgc

SEQ ID NO: 412410 - DNA, 264 bp, Homo sapiens
cttatttcttctgcctctcatctgccttgcctaggcagaattattctcaagcctgcacatgctgctgtgcctctctggcttctaggccaaaacataggctaatagtactcttctcagctcactgagctctttcctgccgtcattcaaatcacctctgaaatcctgccttttgataaagtaatttctgactgatcagaggaaagtgatgattttctctgtgacatgtctttttattttccatcacactcagtgtcttgtccttct

SEQ ID NO: 412411 - DNA, 451 bp, Homo sapiens
tgatctgcccgcctcggcctcccaaagtgctgggattacaggcgtgagccaccacgccaggccgattctatcatttttaaaatttgggtttgcgttacttgctaataccagtcagaaaagagcacttcacagaatcaagtaaccccatcagcaacagagcacagcctctctgtactttgtaaaacagtagaagtcaattgttgccaagaagaaacccttgcacattccccaaaaaacactctgtgtagactatctcagaaccagacacggaaacaagcgctggaaatacacaggaaattaggggagtcctctgccctcaaggagactagagagagcagattgggagccatcttcccacgaaataatccagaactaaatgtgtaaagaattcttagaaccatacaaagaagaatacttctttaaaaggttgcctgaactatctacaatattg

SEQ ID NO: 412412 - DNA, 506 bp, Homo sapiens
atttttctgagagttgaggcaaatgaatgaatcagtaagtgactataaaatggttattctaggttatttttgtggttctctttaaaaacttcagtttaccaatttcagggagacttgtctttttttcatgctatttgctgtcctcatgctgtgaaaatgttactttgccttattttttcaatttaagtggtctcccttttactttattcttttcctcttaaggccctgaaggtagctactttttatccctgccatcctaagcggtcaccctttttctttattcttttcctcttaagcctctggaggtagctactttttacccctgccatccttcagtaatatcctctgatcgccatgaccctcaaaatcatctttagtggattcctaggagctctgagacaccctttcataaatccttctgctctcagagttaggcagttgttaaaaaggtggcaaaccaggaagatagtaagaactccaaatgatgggatagggatacccttctt

SEQ ID NO: 412413 - DNA, 494 bp, Homo sapiens
gtcaaggggtacaaagtttcattagatagaatgaataaattctggagatctaatgcacagcttgatgactatggttaataataatatattgtagacttgaaatctgctaggaaagcagatcttaaatgttctgactacacgaaaaatgataactatgtgaggtgatagatgtgttacttagcttgattgtggtcatcactttcactatctatctctctatctaagcatcatgttgtataccatgaatatatataatttttatttgccaaattaacctcaataagtctggggaagtttgtgctctaattggggtgtcaagccagtaaactgactgaccattataaaatgaggtcctggccagacgcagtggctcatgcctgtaatccctacactttgggagtctgaggtgggaggatgacaagagtttgagaccagcctgggccagatggcaagatcctgtctctacaaaaaatttaagaattagctgggcatgg

SEQ ID NO: 412414 - DNA, 405 bp, Homo sapiens
ctctctgaagttcctgttagcagcttagtttggacttgacacagccgtgtgaactcagagaggcaagtgggtggtcacaggtggcccacacctgcagggttagagatggaaggttcagggcctcgatctgctggtggggctggcgcgggaggccagggcagggctcctccagtcattctgcccccaccccagcttccaggcaaaaatggctccagtgggccgtcactccagtctctgtgcaaccttcaccagcacccacgggttcaaaaataagaagcaagcgaagaaccgctgcctgacagtgcactatgagcattctcctggtgcctgactcctccctgaaggttaagaaaaaagttatttatatggaattccacaattcacacagtggattgacatgataag

SEQ ID NO: 412415 - DNA, 503 bp, Homo sapiens
ccatcctgcccctgtccccagaagccacccctgccttgccagctctgcggaggctgggcgaaggtagactcttgctgagcaaacttccgagacctaaacaatccaaatgaggaagaaaacacaagtgcaagcagagacttcctctggggcgtggcgagccctcttcctcctcttcctccacacgggtggctgcagtgagcccggaggcatgtgtccacaaacctgaatacaagtgagaattgagggggtctgcgggcactttgccttggcctctggctgaggaggtcttcccacccttggacatctcagagagtctggggtccgggaggcaggtggccaccagcacacagcacctgtgaacctggcatctgctagacatttgcacagtggcatcggactgggttcccctggggtcactgcacacaaatatctcccaaaccccaagccgagcccccgctgttgcagccacgagcagagccagctcctctcacagaccagcagcg

SEQ ID NO: 412416 - DNA, 375 bp, Homo sapiens
cagtgaagtactacgaacaggatctggcactggctaaagaccttcacgacaagttgagccaagcaaaagcctactgcaacttgggcctagcattcaaggctctgctgaatttcagtaaagctgaagagtgtcagaagtacctactgtccctagcccagtctctgaataattcccaggctaaatttcgagccctaggaaacctgggcgatatattcatctgtaaaaaagatataaatggtgcaataaaattctatgagcagcaactgggcttagctcaccaggtaaaggacagaagattagaagccagtgcatatgcagccctgggcactgcataccgaatgatccagaagtatgacaaggccctgggttatcaca

SEQ ID NO: 412417 - DNA, 925 bp, Homo sapiens
aaaaaaaaaaaaaaaaaaagagaaagctctagtggcatgtgaggctcacagtgagactccggctctgagtggagaatcagtgtttgctgggactttgacctctttctgtaaaacagatccttaggagaactccatggcagagatgcctggagctgggagtatccctcaaagccagggcctgggatgggcattagcttgtgaaagcaggctgataaaagggttgactgtctgtctgggactgttgctttgtaagaaagtgggcctagtgagggcaagggagaaaaacatgactttttgaccaaaaacagcaaagtagcctgtctgctcaagtgactgaatctgtaatattagtgtatcagcacagaagatttgaaacactatgaagccctagatcttaattgaaggctctggaggaacaggtggagccaactgcacatcttctagataaagtagagtaagagaaagaaaagggagagatttaaaaagtaagaaggtggccgggcatggtggctcacgcctgtaatcccagcactttgggaggcttgaggtgggcggatcacaaggtcaggagatcaagaccatcctggctaacacagtgaaactccatctcttactaaaaatacaaaaatttagccgggcgtggtggcgcctgtagtcccagctacttgggaggctgaggcaggagaatggcatgaacccaggaggcggagcttgcagtgagccgagatcatgccactgcactccaacctgggtgacagagcgagactccatctcaaaaaaaaaaaaaaaagacaaaaccttaacttttcattcaaagacactaaaaaacttaagaaaggaatgacagatcacatttgagaagataatcactgaacatctagatttcagaccgggacggtggctcacacctgtaatcccagcactt

SEQ ID NO: 412418 - DNA, 324 bp, Homo sapiens
gaagtggtatcctttaccatctagcacatctgccgcccccatttcaaaaggcatactcatctttatctcaacattctcatacagttccttatgtccatgcacctccaatgtcccctttgatgtctttgaggttttcatcttccatgtctgctatttggaatggtcttgatgggaggcaagatagtgatcactacaactaggatgggagtcttagtaccgtgaggctacagcaagtcccacagagggcctgctgcactgtacttgcctctgtcaaccaagtctaaggagaaagattaagcaggcatattaaaggacagcccagat

SEQ ID NO: 412419 - DNA, 500 bp, Homo sapiens
tataaaatatgacctaactctatgctacctaaaagagacaatttaaatctaaaggcacaaacagacaaagtggaaggatgagaaaagatagtccatgcaaataataccaaaagtaaactgaaatggctatgccaatacctgacaaaatatattttaagataaaaattattttaaaaacaaagacattttatattgatttaaaaaatcaattcatcaagaagatataacaattataaacatacacacattgcatacagcctcaaaatatatgaaagcaaaaactgtcagaaatgaagacagaaatgggcagttctacaatataacttggaaacttcaataccctactttcaatagtgaatgtaacatctaaacagaagatcaatatggaaatagagaatttgagcaccataaactatacctcaaagagagatacagaacactccttccaacaacataatgtacattcttctcaagtacacatgaaacattctccaggatac

SEQ ID NO: 412420 - DNA, 138 bp, Homo sapiens
aattcttagtatttctgccgggactttgaaggcctttgccagttcacagaaccgtgtcagagagcactaggaggagatcagggctgaaattagcatctcagttttacagatgcagaaacagaggtcgggggagacatg

SEQ ID NO: 412421 - DNA, 361 bp, Homo sapiens
tgagacggtgtctcgctctgtcacccaggctggagtgcagtggcgcgatctcggctcactgcaagccgcctcccaggttcacgccattctcctgctcaggctcccaagtagctgggaccacaggtacccaccaccatgcccagctaattttttgtatttttagtagagatgggtttcaccgtgttagccaggatggtctcaatctcctgaccttgtgatccgcccgccttggcctcccaaagtgctgggattacaggcgtgagccaccgcgcccggccgattccagtgtcttatactctgaagggactcgtgagggaagaggagagagctgggtatgtactgtgtgcagcttctttttctc

SEQ ID NO: 412422 - DNA, 650 bp, Homo sapiens
aacaggggttttgggccagtaaggttgataagtgttgcatattgtatcaccccctcagagatttcacggcatacattggtacgttaaaagctttgaaaagtactatagaaaagaaacttcagcattttagcatatctttcacaaactgacctggtcactgatccagtttttaaagaacatccagttttctttaaagaactttagtgtcctgagagaagagaaagcgctgtggacagatggacctgtcttcaggggaggaatctggctgcctctgctcgctgaattctgccttgaggccttcctttcatgttcatgtgcagcatggtatcatccagctgtgtaaatcttaccatccttcaagatcagttcaggatctacctgttctctgaagattttcctgaccacttgagtccataccgatatatctgacctcagcaaagttcctgattatgattgatggtaatgctctttagcacgtggctgtttccccagttggttcctaaactcctcaaaagcagacacaccctactttatattattcccctgtccgctgctgagtagcccctggccttactgccctcgagggagaggttaaagtgttccagtggtttttgtttggtttacaaatactcttcgtctccctggtcttg

SEQ ID NO: 412423 - DNA, 453 bp, Homo sapiens
aatgtgagttggaggagtgggtgatatgcattaagagccttaaggatgttcatttcatttccctcagtaatttcacttctgggaatgtatcctatggaactaattagagatacccacaaaaatgtgctgaccaacatactcattgaagcattatttataatatgaaaaaactgaaaacctaaaacttgaatattaaggtatgtgttaaattgtatatggctgctgcatagccattataaatcatcttcttaaaaaatatttagggtcttgagaaaacagtgtattattaattgaaaaaagcaatatgtaatagcaaaaacacaatgttgtaataccaatttagtatttttaaaaatatgtgtatagccaggtgcggtagtgcatgcctgtagttccagctacttgggagactgaggtaggaggatcgcttgagcccaggagtcctgggctgta

SEQ ID NO: 412424 - DNA, 189 bp, Homo sapiens
cctgcttcttgcctccagcaacagaagaagccgtatctctggtaatggcttaagaaaccaggggccataacatggggcagtgacatcctgggaaggtgggacgggggattgaagacagaagggcacaggttccagccggacatggtggctgatgcctgtaatcccagcactttgggagggcgaggcagg

SEQ ID NO: 412425 - DNA, 284 bp, Homo sapiens
cagtgtgtgaatgagccagtgaactggtgtcttgacaatttatgttacgtcatgtcatacattttttaaaaatctcatttcatttgtttatcttacaaatatttattggatactcactatgtgtcagacacaattccaagtactggggatgtaacagtgcacaatacaggctgccatctgtgcgttgtgaagcttattctcatttgacgatacccgattgctcttcatggtgtgctggcgccacgttcttgctaacggcgcccccgcacactcctacactcctt

SEQ ID NO: 412426 - DNA, 320 bp, Homo sapiens
catcatgttgaaagaactagagacatttagtagcctcaggacagtccctgggttaggctcactggggcagattgctgaaggcagaaaacaaatgaaattctcatgaggcccagatattaatgtctgcgtgaagtgtctgactcatgcctttactgcaaagtcctggataaggattaactctgggctggaaaatcgagtcataagactgtcacattcagatccaaggggcccagatcatccaggttatgatgactcattttcaagtggtctggattattgtctataaaaaggagagcaagggtagggacactttttcctcc

SEQ ID NO: 412427 - DNA, 332 bp, Homo sapiens
tgcttgtctgaagcttactcatacaaaatggtatttttaccatctttatttcaaaacctgtgacatgtactaggaaacgaagaaaaaaattgtattttttaccacgtttaatgatgtatttctaactgctatggtaaagctgtcttactcctaaaagcacaagttttcttttttttttcttgaactcctgagatcaggagttcaagaccagcctggccaacatggtgaaaccctgtctctactaaaaatacaaaaattagctgggcgtggtggcgcacgcctgtagtcccagctactcgggaggctgaagcagaagaattgcttgaacctgg

SEQ ID NO: 412428 - DNA, 745 bp, Homo sapiens
acaagatctatcatttttcatatacatattcatactttatttttaagaacttaataatttgagatttttagacattccttgctatatcttattaatcaaactgaaatatcacttcagcttaagtattatgtcattgtaaattccactaatcaaaattattgctgagggtacatctgaaaattgatagcctaagaatctgtgaattaagtgaatttcccactaagaactattaattgaaaagatgtgctctcagttgtaaatgtattcatatttaatcatcacttgttaccaaaatatgttctcctgagctatgttaaagtcttacttcagcaagaagaagatggagcatggttttgctaccatagcctaaattgatgttcattatttcatagagaagtcaagacactgatcttcaaagactcaggctgctcattttagagaaccttaaaatttcttcctccttgagagtaaagcattcttcccttaccctcacatggttcttcctattagtgttatatttgcctgtaaaaactgggtgttatagctaatgtcatattccacataccatctcttggtagggaaaaagtttctctttaacaaaaacaaaagcaggaaactgtgtaggtgttttctatttgctgaattctgtaaggaggcttcaaatcatagacattgagacatctttacaagcgatgaattctgagagtctttataaaactttcaggatttgtaatttgtggctaag

SEQ ID NO: 412429 - DNA, 358 bp, Homo sapiens
cagtctctgaggccaccccagagctgacacaatgggtgtataaacagcaaccatggtggtgtagtagtccattttcacactgctataaagatactacctgagactgggtaatttaagaaggaaagaggtttcattgactcaaatttctacatggctggggaggcctcaggaaacttacaatcatggcagaaggcaaggggaagcaggcatcttcttcacaagacagcaggggagagagagagtgcaaagggggaactgccaaacactttgaaaccatcggatctcttgagaagtcactcactatcatgacaacagcatgggggaaaccggctccgtgatccaatcacttcccaccatg

SEQ ID NO: 412430 - DNA, 234 bp, Homo sapiens
catttttgtttttgttttgcagagatggagagataggctgcttgggtctttggttgggtctttataaagctttgcttatcttatattgcttacttaattttggagggaaaaaactaacagacacaccctggtgatggttctttgttcacctcaaggctttgttgttgtgttgttgttgtttgttttttgttttgttttgttttgtttttagatggagtctcgctctatccccca

SEQ ID NO: 412431 - DNA, 333 bp, Homo sapiens
cctgtccccgacactgtcccccacactgtccccacctgtccccaacactatcctccatgctgtcccctcctgtccccacctgtcccctacactgtcccccatgctgtccccaccagtccccaaaactttcctccacactgtccccacctgtccccaacactgtcccccacgctatcccccctgtccccgacaatgtccccactgtttcctcctgttccctcctatccctgacactgtccgccatgctgtccccacctgtccctgacactgtctcccactctgtcccctataatccctgacactgtcccccacgccgtcccctcccgtatgcac

SEQ ID NO: 412432 - DNA, 324 bp, Homo sapiens
gcccagggcagagccagggccgacagtggcttgcgttgacagccccttcccaggcctggaggagcaggtggtcagggcagggactcacagccacagtgaggtcagggccagcttcctggaggaggttgggatgtgctggtgggggccagtgtgaggacgcaggtccaggcagagtggagacggcagagctctgctgaggcctggggcccagccgaaggcaagagaggcaggggagccctttcctgctgtggagccggccgtggacagttgcaggtgctgaggctggagccaggctgtattttcagggtggggtagcggctgctt

SEQ ID NO: 412433 - DNA, 456 bp, Homo sapiens
cagtgaaaggtatcgtgctgttgctggctgctgagagaagagagtgaccagagcccactgactgtaataccatggaacagtgtttgtctcagacagaagggctggcttcaaatctttgctctgccattcgtcaaccttgcccttgaatcagaccctcacactctctcaacttctgttttcctacctgtaaaatgggtgcaataatatgtgctgaagagatctgtgatgagaattatgtgagaaactttattttgtttatttttacttaaagagacctagcacacctggcagcatgtgactgtcaattatactgtgaaatgggttaatgagttagtttttatttcttcttttttaggactctgaattgaatctggaaatatatatgccctttcatctcttcttttaacttcaactctatttttctgcagggattaataaaagtttcttgtttttaga

SEQ ID NO: 412434 - DNA, 407 bp, Homo sapiens
agtatttactagagtcagtaaaatgatacttgcttaagtagagtagaatataaacatagaattatttaacactctattgcaataaaaacgattgtttcttagagcacctatcagttaaaagcatagcacctagctgggggaaagctttatgtaatatattctggctgaaaaagctcaagtttaattctgagatagataagaattaagtatctttttagacatttttagttctattatttcctaattcttttatatatttttaatgatttgcttgccatttagttacagcacaataactaaatttgtgataagtgaaattttcaatatgcattatgaatttcactttgaacttaaatttggtttaaggtatatgccactaaaggaagtagactataaaaatttttctt

SEQ ID NO: 412435 - DNA, 200 bp, Homo sapiens
acacactttgagttatcttattcctgctctgtgttctcattgcatgagatccttgggtgcaggaactacgtctcctccttgttctccagagtacaaatttttctttcaataactgtgcactgagctccaattttgttccaatggctgtgctaagctctgtagatgaagtcgaaaaaaataaagaagtaaagacatcattg

SEQ ID NO: 412436 - DNA, 434 bp, Homo sapiens
aagggcaataaagaatgacgggtgtcttaaaagaggtctatttggggcacgacagggagaggaagccaccctctctggggaccaagagtaacagcactatagaagaaatgacaccgaagctgtgtcttgccaggtgaacagctatttgccatgtgtacagataggaaaaggtattccccatagaaaaacaagtagggacagagcccagaggcatggcctattcagagagctgtacgtggtttggtatggttggaatgtttgctttaagaatggagaggtaggcaggggctagatcatggaacatactgaatgccatgctaaggaatttggacttttatctgtggacaatggggagaggcagagtgggcacagaggcaggggaataatttatattttagaatccctctgacggtaaaatgaaagctcacctgaaa

SEQ ID NO: 412437 - DNA, 288 bp, Homo sapiens
tttgttggttataacccagtgaaagtattgccccagagtcatggatctcagtaaatacaggatggttgtttgagttcattaggacacattttgcatttagattaattcagtccatgcacagttaagcaccaaatagttgctttcagataattgttaacaaagtgctcatttagaaaagaaataatagtataatttacggcatgaaaatgtttgagcagtactagaataaataaatgctaataagtgaatatataaatggatatagaattaagagaaaacaagcttgca

SEQ ID NO: 412438 - DNA, 480 bp, Homo sapiens
tcctgggattatgggaatgagccaccgtgcctgaccggaaacctttttgtttgcccagtgaggcgaagaaacgccgacactttttagcacttaggtaccatgatggccattttacagagaagaaaatggaggtggacctggtgaggccaggactgctctcttgacctctctgctgtgccgtccactgtaggtacccaccaggcccacccctctgggcaggccaggggaactgaagggaagggtctggggtggcctctggcccctcccctgcagggtgactgcacagcgctcaggaggggctctggtgctgactctgcagccaccctccacatgcacaggagcttccctggctcagaatctacccaaggggctgggtgcagtggctgatgcctgtaattctagcactttgggaggctgaggtgggtggattacaaggtcaggggtttgagaccacctggccaacatggtgaaaccccttct

SEQ ID NO: 412439 - DNA, 459 bp, Homo sapiens
ttaaggatgattactgctgagtggaaagaattatgtggaaggaagataatcacagcattgtctatgatagtgaaaattgaaaacatcttaaatgctagccagtaagggattatgtgattaataccttgaaccacttataataatgtgttagaaaagtaactgaaaaatgagaacatgttaaaaataagtaaaaaaaaaaaaaagtcacaagacaatgtagaccattcaggaagctggtatggtaggaattctgctctgttcctcacagttatgtggcctcaggcaggttgcttgactttttgttgcacagaaattttcttttcagtaaattggagacattgtgtctcccctgcaggttgctataaagattggtgagatgtttgtatagcacttggtcctgtgtctgacaggtagtagatgttcagttagcagtgaatattattacctgatttctgtaaa

SEQ ID NO: 412440 - DNA, 517 bp, Homo sapiens
ctgtaacaaggttttggaaagcatcattgcaaatagttgatctaagaaaatagcacagagcattggtttggagcccagtctcgagttcagtggcctggattggaatttcagccctgcaaccagctgcttctagtatagaagagtcactgaccctctctggtcctctatgtcctaatccctaaaataaggataataacctcagagttgttatcaagattaaatgagttaatatttcaaaaaatttaaagcaatgcgtggtacatagccaccttcgtaaaaattttgttaaattattaaaactgagtgactgtatggtttgtactgcagcttgatcagagacgtagtgggataattcttgacctaactagcttatgtaaactattgattatgttatcttctggatatattggcttacgcctctaatctcagcactttggaaggccaaagcagaagactgcttgaggccaagagttcaagacccacctgagcaacatagtgagaccctgtatttaaaaaa

SEQ ID NO: 412441 - DNA, 629 bp, Homo sapiens
ttttagggagatacactgcagcctgcaacagtcatgttacccaggaaacagactctgagattgagatttgcttgcaggggatttgtaatggaatacactggggaacaacatccttaagggagggagggaagctggattaagctgaaagagaagttgaactgcactgcagtataatggaagcttcaggaaattccactgggagctctgaagctgggaaggcttttcagagatgttcataattaagataggtggtccaggcttttgtactcctgcatcatccagtcattggatgtaggctgccattggagaggggcaaagcagctccctttagcctaggacaggtcccatagagggacatagaccaggattgtcagcaaatgtgggaatgaaggtcttggtcctggagggaagatctgggatgccttccccagcacccagcatatcatgctttttaaatagagctcaaaaataagcaaaatgaaacaccatgttattatttcatatatattttgatataagcatatatatttaaaagcagtagaacgatatacaacatttagggctgtgcttacctttggagaatggactagggtaggtttttggtttttggttcttgagttaggtggtga

SEQ ID NO: 412442 - DNA, 883 bp, Homo sapiens
ttttagggagatacactgcagcctgcaacagtcatgttacccaggaaacagactctgagattgagatttgcttgcaggggatttgtaatggaatacactggggaacaacatccttaagggagggagggaagctggattaagctgaaagagaagttgaactgcactgcagtataatggaagcttcaggaaattccactgggagctctgaagctgggaaggcttttcagagatgttcataattaagataggtggtccaggcttttgtactcctgcatcatccagtcattggatgtaggctgccattggagaggggcaaagcagctccctttagcctaggacaggtcccatagagggacatagaccaggattgtcagcaaatgtgggaatgaaggtcttggtcctggagggaagatctgggatgccttccccagcacccagcatatcatgctttttaaatagagctcaaaaataagcaaaatgaaacaccatgttattatttcatatatattttgatataagcatatatatttaaaagcagtagaacgatatacaacatttagggctgtgcttacctttggagaatggactagggattggacaactgaatttaaaggcaagttaaagttcaatattttgaacaatgtttaaatcaagatgagcgagaagacagaactgttaaaaggttttattttacagccaagtgaaggattcagctatgtcccaaaggattaaacaagatggtatgcttaataattcctcgcttctatgaaactccctgattatgaagtgtactttcattctatagaactactcctgatttcatcaggaaactctgatctgaaactcaatttacagaaatattaaaaatgaattttcgactaaa

SEQ ID NO: 412443 - DNA, 507 bp, Homo sapiens
caattacagtccaattcctttataattgagctccacacagctcccagtgatagctattttagtttcaagacttaaaattcaactccacaattttgttcatcgctaacatgaaaatgcatggtttcaactctacatactaacaaagtgccaatgggtcccaaggtttcagcttcttgaacctacatttttctgtttttcatctttgggcaatataacttagccttatttccatgtatatatttaaacaatgaaaatatttattgacatggttacatttctcttttgcctagcgtgaatctctcatcttaagcagggatataactaatgagtgtctcatgacggttgccctatatcaacagtttctttaaaagttttactgagatgtaattagcatataaaaatgacacacatttacagtgtaaaatttgataaatctcatcatagatgtatatacctgtgaaaccatgcccacaatcgaactaataaacattacccccaatgaactct

SEQ ID NO: 412444 - DNA, 469 bp, Homo sapiens
gagacatggagagatgatgtgttaattagtgaagaaaccagaatgggaaccacattttatgacttcccactgcattgaagtgcctctcatagtatgagacttctgtatttagtaaaggagggccaacacttgctccacctattataatagatgaggtatgctttttatctatatacttaaaaatgtagttttaagttcattgctcaggttctttcggtggcaaaaatccttgcactttaaaaggcattattattggccgagttttaaaagaactaccttcagagaaaaatgcatttcattttgattatgcccaacgcctgcagaataccatttaaactacaagtgatataaaaggttaagtatttgattaaaactaatctcctttaaaaactaatgtttcagtctccaccagaacttcttcagggaacttcagtgttttgctgataactggatccaatttatgggaggt

SEQ ID NO: 412445 - DNA, 462 bp, Homo sapiens
caggatgctctccccagctgtgatagaggccaggttagcgagatccaacaaagattttatggcctcttaggaggctctgcagagatgcttgacttcaggtaatgagaggtgggaaaaagagaaggacagagaagaaatagtgtgagaaggaatagtagagaggaacagaaggaaggtatcagagaaatgaacagattgcttcctatctcacaaaaatatcagtgagacattctagggacctttgaccattgataggtcaagaggaaggaggggtcatggttgatactcaggctttctttccatcctcccaccgtgagagaagaaggcaaggactaataaaccaggctctgaattgatgtccctgcctctattctgcttcccagtgtctactgtgcacaaggcagccagagagatctttataaaactaaaatcagattaaactctttgctcaaagcccttttg

SEQ ID NO: 412446 - DNA, 378 bp, Homo sapiens
tgaattctcccaggaactgagacctgatagtcatatattcccctctcccttcctcttgactgctccggcaggtggcatagactaatcatgaactctggagtaagacctgagttgaatcccagctttgccacataccatcagggtgaccctgggaaagttacccaacatctctcagcctcagtttctttagaagggagccaataatacttcccctcaaggttgcagtgagaatcagtaataaagtgcctggtatgtcacagttctcaacaaatgttgactattgtattattactttaggtctggggtaggcaaaccaggccagcgcaaaatctgccccccgccaccatttttgtaaataaagttttattggaacacagg

SEQ ID NO: 412447 - DNA, 476 bp, Homo sapiens
caggtgtctgctggaagcgagggagtcagccatgcaagtatctggaggacaaacatcccagtcagagggttcagcaaatgcaagatccctgatgttggaatgaggtctgttccacattatcttcactctaggacccaagctgataaagcagctccctctggagctattgatggtctcatggaagagacaaaaaaagatcacagtgaatcacattctgcttctgaactcttctgcctggaagtgacaaacatcatttccatcacatttcactgaccaaagcaagtcatgagtggcattcctgctgacagccatttctggctgtgtatgagatatgccatggagacatgggaggaccagatggcacttctgagcctcaccctcagcaagaaggcctttgccagatgtggctctttgaccttggacttcccagcctccagaagagtaagaaataaatttctttttaaaaaataaatcaa

SEQ ID NO: 412448 - DNA, 443 bp, Homo sapiens
cagtttactgctctggggtggcttctccagtgattctggccggtgcattaggaagccaagtttgcattttggaggttgtggactcagcatatgagtcaagtttctttgcaaagaaaacctgagggttttgttgtattctaatttataattaggcattaggcaaagtagcaatgaaggatcttacttcagcaggtttactgcttgattttgcttttggttctacttagcaactttaagtagagtaaaggaagcagctatactccttcagggaatcaagatatgacaattggacatttggatattcatgtgtttttttaggatggaacctctataaatggaatgacacttctaaggtccaaaagtaaatataaattttaaattgttcttttaaatctatgcacatttctcagaatctcagaaaaaataaacattccaagaataaa

SEQ ID NO: 412449 - DNA, 491 bp, Homo sapiens
gagaagcaggtccctcacttaagaggctggtatttgattgaggctagaaagtgcatatcagtctgaaattcaaacaaggacacctagaagccctgtaatttgggacaaatctgaagttctctttatttctgcactgtaaaggcctttcctggcggtgcacagatttgttagctctccaaacacctgttcaaaaagcgcattacttatctggcttgaatcagcctgcttgatcaaatcctcttgcttttctggcctaggagtggtcctacaggagtctggcctagacagtaaatagctattatagcaaatcgtgttttcttgcttcttgtttcttgttcctaatatcttattgtcatacaaatcttacattttgtaccttattcccagaggaaaatttgaagtctgggcatgggcagcggaaactacagggaccttagatatttggtttatggactaaagtgttcgtcctgacatgatatctgtctcacaaa

SEQ ID NO: 412450 - DNA, 584 bp, Homo sapiens
tttggtaagattgaatgattcgccacgacaattcaagagcagtggttgccataaaagtatcttgaaagcattatttaaatagtggaacactttactgatgatagatgtaaacaatgtatatcaagttcagtctaactattaaaggttaaaataagagaaacagcaagtagtattttgctgtaaaaaacacacgtaataagcacattttaatttttttgatgaagagacccaaattatttctgtaatgggatttggcataacaagcatatttgagaaatcatatcactattctacaaaatgacataaaggaaaattagtattcagattctcaattattgtagagaaagtagcataacagatttatagggtcaaaaaaagtgtgaaaatgtaattaatcaatgagagcaagattgcttaaaagtacatcatttttcactttcaaggagatagcctatgtaattgttcacccaaagagcatattgtggaaattttaaaagaaaaatcattcctagtcttttttttcatcaattccaatatgttctggctgtcatttactttttcaggtagaagtggaagatggaact

SEQ ID NO: 412451 - DNA, 520 bp, Homo sapiens
gacatgggatcctgagtgccggaggaaaggggttgctcttttaaatcatgtgatcaggcctccctgataggatgacatttgaacagggacctgaatggaaatctgggagatgcacagaccaggactggtccagggaaccggaagggtggccttgcagccagaaggactttgctccctgtgcccaccagggagagccgggctgcttccgaggagcgccatcttggggtaggaagaaggacaggggcccagctattctgtttagcctttgttgtaagggaaaaaaactcaattacacctacatttacaacatataggagtgagagccagtgtcgttaccagaatgttgcagaccctatactcaggtgtgcagctgagacgacttcatggggccagagtctcagatttctacttgactttacttaatagcctggggtctgttggcctcctgcccttagcctcagagtgacatctgtgtcacttggcttcttgcttttccaataggaattctttcttcttcaga

SEQ ID NO: 412452 - DNA, 574 bp, Homo sapiens
tagatgtcagtttgggaagaagtgtcacatgtcatacatgatacaagagactaatttcccactcagctttagagatgtacttgtgaaatagctgtattttagcacagataatttacttggtatcttagtatcttaatgatagttccagtgagccatttggtttttgaaggacagttcagggagccacatcctaacagcttgaccgctctcatttctggcatgtggaggtgccaacttcctcattccctgccctcttaacaccacaagctgtcagtttcccagtcactctgaactgttggtagctttacaggcaggttgctgtgcagtagatctgtgtttctgataaatactgggttctgttttgcatccaggccaggtatatgaggcaatcagctggagccagtacatggacatgtttcattgttctgtctggagatacagtagagagaaaaatgctgggggtttggcagtggagacctgaatttgagtctgtttatgacattggacaagttcttaactgccttgggcctcagctcaccctgaatgggtaaattaaatgacctttgccatacca

SEQ ID NO: 412453 - DNA, 359 bp, Homo sapiens
tgtaacaaatattgtctacaaaattgtgttaaaagaacacgagccacctgctcacactcaagatgaatcaggtgcaactgctaagagtggatattacccccatgtaggctcttgaagcacattagtaagaatatcatttaatgcattttaaagataactatgattctctattagaatgaacaatctacactgtaccaattactacaaatcctgctgtgtaatttactgtacctttcaacataacatttcattttaagatttaaaatttctagtttttaattttaagattactcacaaggaacctgagaaaacattccccacctgagcaaaacaaataaactcttatttctaaaagcaat

SEQ ID NO: 412454 - DNA, 430 bp, Homo sapiens
atttggttcaaagtctcagcaagggatgtacctggctttggttattgatgagaagagtaattaatagaacattccctttgctgtgataccctacccaaaatagctcggttgttggttcactttcttcagatacctccttgtctcatggaccgcctacttactcccaaatgccattctgaacaaccatttgtaaccacctcctcccaaatgccctctcccaactgcctttctaaatcaatgtttcactgtcctaatttcttactgttctttgcagttgtcattttaacctaagagctaattatctttgccaaacaccattcctaataggccaaactttcaaactgaaaaaagaatcttaggaagtcttttggtaaaaataaatgttcccttatttttggttattagtattttgttttttattttaaactat

SEQ ID NO: 412455 - DNA, 382 bp, Homo sapiens
ttgagcaagagtggcaaaagtggagtccagagagaacagaaagaatactgggatgagtttctgaatacagccagccacatccgggaagtggaaaagaacgagacattgcctccctctcagccttcaagatgccaaggtagcagagggctttggctatggccagcccattcttgcggaggacagttggcctgggagcaacacaggctgtaacagattcatgtgttctgctgaggaacagctggggagagaatggggtagaaggtggggaagttttgaccccaggaagcaggacataggatttcctgggattttatatcctcatcagtcctctgttactttcttgtggtacttcctaataataaattagcatccaactctattc

SEQ ID NO: 412456 - DNA, 414 bp, Homo sapiens
atggaagagcaacatccagacagaaaagtgcacagataatatgtgtactgcctgatgatttcttacagactcaacacttccatgtaaccagctcccagatcaagaaacagaaccttccaggagcctcctggtgtccccttaatcactacccctcctcccaagatctaggcacagaggtcactctgagcttccatttggacagctgcctgttcgtgggaagatcaccaagctcttaacccaggaagggatgctgtgctgcatattggcgttgttgtgaggtcaagagagatttcatccctgctgtccttcctcagatgggtcattatgtctggattcaggaagagaatatgcaaatgttgagtctgtgcctcttaacaaactcatcctgcatgaaaaatcattatttacttcatt

SEQ ID NO: 412457 - DNA, 493 bp, Homo sapiens
ctgtaactgtgttgcttttttagattaattcgaaatttgaaaataattggtaacttattttgtttcttgaaatacatgaacgtagaatatcattatttacgtgttttaagacttctctaagcaataattcataatttatttaaaattcctatgtctttaacattgtttattatatttattaccatacatataacaatctttgatgttgtaatcatattacatttctaattttattttttgattgttgcagtgtgatttcagagactaaacagtgctgatagctgttagaccctgggcctagccagagtgaagagccttgtggaacactctgaacattcatttcagatgtaagaaataaccttaggagtgcagataattgattatggaagattgatcttatatctagtaccttgctaaattcacttattgatttcagatttgctatatgtaatattatgtcatctacaataaagactatgttatgctttccatc

SEQ ID NO: 412458 - DNA, 827 bp, Homo sapiens
ttttttttcctgaggatggtgaaggtacctgactgtgtgaggtggtaggagaatgagagaaacctcagtcagtgtctcaaaataaaatcctgctacaaacattgatctcttttcatagcctaagggatgttgcatcgctaaaccctgttgacttctctaatctcttctgtagctgatctccttcccttgctacactcggttactctggccttgattctgatctccaaatacattatattttttatttgggaccatcgtattgcctttgcacctttatcaaatataagttgcctatatttatttggatctattttttgggcttttaatattctgttccattgacctatttctcttttcttttaccaataccacaacatcttggttactgtagcttcacggtaagtcttaaaacttggatattgtcagtcctccaactatgttctactccttcaatattgtgttggttattctgagtcttttgtctctccatataaattgtagaattagattgctgatatccataaaaaaactttctggagggccccagggagcgcggggcgccgctgctgctgctgctgctcctcggctgggttgtgtctactgggcccgcggctgcggcggcagaggggcctgagccgggagccgcgctcagccgagagttgggcagagggagtgcccgcgccgccgcggcgtcatgggccccctcccctcacctcagcgggcaccagccgcgggaacccccgggcctcctcgcgcccgagcctgagcgacccctgggttctccggcgccccctccctccccctatttttcttttcctgctcttgct

SEQ ID NO: 412459 - DNA, 465 bp, Homo sapiens
ctgtgttcagacttagacttcagaatcaaaattttgaaatatttatgaggttaataactatctttgaagttaagcagtttactgagcaattaaatatttttgtccatacacattcagatttaactactgctataaattgtcgtaatttctccagtttcagtctgaacataatagcttatagtaataagacacaggttctagtacagattttccaattagtggtatggccctaaacaagccaggttagatctctgccttcacctacatcaaacaggaataataatatatttccttaacctatcttctaggtaaacagatgagattatatgaaaacattttgctaaagtcgctaaacaaacataagaaaaaatatgtaaggtttttctatcacattaactattttttaatatctgactgacatttttgtaatataaccaaaataaaaattgcatactttcttttttt

SEQ ID NO: 412460 - DNA, 469 bp, Homo sapiens
aattagctgggtgtggtgtcatgagtctgtagtcccagccacttgggaggctagggtgggagggcgcttgagccctggagttcaaagttacagtgagtcaaggttgcaccactgcactcgatcctgggcgacagagcaagatcgtttctcttaaaaatacatacatatatatatattaggctgggcacggtggctcatgcccgtaatcccagcactttggttggccgtggtaggcagatcacaagatcaggagttcaagaccagcctggccaacatagtgaaaccccatctctactaaaaatacaaaaattagccaggtgtggtggcacacacctgtagtcccagttactgaggaggctgaggcaggagaaccgcttgaaccagggaggtggaggttccagtgagccgataccgtgcccctgcactctggcttgggcaacagaatgagacttcatttcaaaaaaaaaaa

SEQ ID NO: 412461 - DNA, 495 bp, Homo sapiens
gggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttga

SEQ ID NO: 412462 - DNA, 349 bp, Homo sapiens
caaacaaaactaattcccaagagaaaattctttattttagggcttcatgggtattcaaactcctatcaggaagaaactgctgaccagtatttgtggagagtgtttttgtctgcagtagcaaaaaaaaaaaaaaaaaattactaaatctctgccatatttttagttagcaaggtatagaaataaatctgattattgccactctgctcagttgtaaaaatcagctgctgcattatagtaattttgtgttgagctttagtgctaactataagtgtttgcctcatacctaagaagaatattacattcactttctgttgcagaagggtagggttgggtaagagagatgaaagtc

SEQ ID NO: 412463 - DNA, 393 bp, Homo sapiens
catctgttcctagcagtgcctggtatatggtagacactgggtaaatatttgtacgagtgaataggggaactaatcattttgagtttgaagttccaacaggaaatgtaagtgatgttttgtagatcattaaaactgtgtatctaaagattgtagcttgaaggaaagttttggaattgtccttactgataatatttgaagcagtgaacagcagatgagatggccaaaggagaaagcacttattaatagaaaagggagagatgggccgggcacggtggctcacgcctgtaatctcagcactttgggattactactcaggaggccgaggcaggtggatcacttgaggtcgggagttcgagaccagcctggccaacatggtgaaaccctgtctctact

SEQ ID NO: 412464 - DNA, 306 bp, Homo sapiens
ttcaagtagctgggattacaggcatgtgccatcatgcctggctaattttttatatttttgtagagatggggtttcaccatgttggccaggcaggtcttgaactcctgaccttaagcgatccacccatctcggcctcccaaagtgtgccactgtgtgagccactgcacccagcctgaatgttttagtttaagttttttcccatagaatctttgaaccaaatgggctttagattcccagtctggaccggaaaaacctatttaacagataatatatccaaaatgtagaaacaaaaaaactatggaactt

SEQ ID NO: 412465 - DNA, 347 bp, Homo sapiens
ccgcctcatacctggacgccctgattccaggtgtatggccagaagctggcacagtcgccgggcgctgtggctcacgcttgtaatcccagcactttgggaggccaaggcaggagaatcgcttgagcccaggagtttgagaccaggctgggcaatatagtgagacctcatcaatacaaaaagttagctgggcgtggtggcacgctgggcgtggtggcacgctcctgtagtcccagctactcgggaggatggggtgggaggatcactcgagcccaggaggttgaggctgctgtgagccgtgatcccaccagcctgggcaacagagtgagacctccatctctttaaaaaaa

SEQ ID NO: 412466 - DNA, 154 bp, Homo sapiens
atttaatataaatttaaagtagagacagggtctccctgtgttgtccaggcaggtctcaaactcctaagctcaaatcctaaagtattgggattacaggtgtgagccaccacacccggcaaggaattctttacaaataaaaaattttgaataatcc

SEQ ID NO: 412467 - DNA, 457 bp, Homo sapiens
catttaaaaactactgctacgtatggaaaattaaatttgtatggaattagattaagaatagatttgttttgtcttccctttaaaacactgctaaaacaagttcaaaatattttgcccaggctgggtgcgagcctgtaatcatgcttgtaattccaccactttgggaggccaaggcaggaggatcacttaatcccaggagtttgagacaagtctgggcaacataatgagaccactgtctctacaaaaaaattaaaaaattagccaggcatgctcgtatgtgcctgtagtcccagctactcgggaggctgaggtgggaggattgcttgaacccatgaggtcgaggctacagtgagctatgatcctaccactgcactccagcctgggcaacagaggttgcaatgagccgagatcatgctgctgcactccagcctaggtgacaaagcgaaactctgtctca

SEQ ID NO: 412468 - DNA, 419 bp, Homo sapiens
gaaaagctatgtgaggcacataaaaaggatttacttggtgaaagagtttcaataaaatcttcatttaggccaggcacagtggctcatgtctttaatcccagcactttgggaggccgaggtgggtggatcacttgaggttaggagtttgagaccagcccgggcaacatggtgaaacctcatctctactaaagatacaaaattagccaggcgtggtggcaggcgcccgtaatcccagccacgtgggagactgaggcaggagaatcgcttgaacccaggagggggaggttgttgcagtgagccaagatcacacaattgcactccagcctgggcgacagagcgagactccatctcaaaacaaacaaacaaaacaaaacaaaaacctttcatttaaagtcagataagtacagacaattcatgga

SEQ ID NO: 412469 - DNA, 388 bp, Homo sapiens
aaggtatagaagcaggaagtagcaaaacctgcactcacacttctgactattaggccagtgcattttctactgcaaaaggcaactgctggggaagtggccaagaaaggccagattgaaattcaatagccatgcgtctttccctgctgtgctatgaacagccaaataaaagttactaacaaaagttcttattcattttctgtgctcacagagtctgggccagacagctggtgataccaacctgcgtaacaggagttaagatgattagggcagtttgagaggtgaggtgggagagatgcaaagtctgaaggaaaaaaatttagatgcaacctcactggtaatcaggggaaatcaataacaatgaaatacttccaataggacaaggctggta

SEQ ID NO: 412470 - DNA, 320 bp, Homo sapiens
tggtatttgtttatgtaaacatatataaacacaggaaaagtacagtaaaaatccagtattatcttaatggaccactgtcgtatatgcagtctctcattgaccaaaatgtcatatgactatttttgtttcatttttctttgtcctgattattatttatcttttctgagagggtacctgagtttaataaagttttttgctccaatacagtttaagaaaaattagtaataatactttacatttgttattttttacttagtcaaatccaactctgtatgccaaaccaaaaattaaaaaagaaataaaagtaagtttaaattgtc

SEQ ID NO: 412471 - DNA, 365 bp, Homo sapiens
tatgtactttttcacttcttttccccccttggtggagaaaggggcatggtggagcccttggtggagggctcccttggtggaggctgggcatggtggctcacgcctgtaatcccagcactttggaggctgaggcaggtggatcacctgagctcaggagttcgagaccagcctgaccatcatggtgaaaccctgtctctactaaaaatacacaaaattagccaggcatggtgttgcatgcctgtaatcccagttactcaggaggctgaggcaggagaatcgcttgaacccgggaggtggggttgcagtgagctgagattgcactactgcactccagcctgggtgacagagcaagactctgtctcaaa

SEQ ID NO: 412472 - DNA, 458 bp, Homo sapiens
gggttttgatcatttttgaaagcagcagaaaactattcttcaagtgattttataaaaaactccaaaatatgggccgggcgtggtggctcatggtctaaaaagccatcagggataaaggtttctctgagtgctgctaaaagaaaccaagacttgggcccagcgcggtggctcatgcctgtaatcccagcactttgggaggccggggcaggctgatcacttgatgtcaggagtttgagaccagcctagccaacatggtgaaactcccccgcagcccccgtctctactaaaaaatgcaaaaattagctgggtgtggtggtgcacacctgtaatcccagctacttgggagactgaggcacgagaattgcttgaacccaggaggcagaggttgtgatgagctgagatcgcaccactgcactccagcctggatgacaaaacaagactctgtctcaaaaaaaaaa

SEQ ID NO: 412473 - DNA, 99 bp, Homo sapiens
aagcaaaatagatccttacctgacacattaaacccatacacacacttatatcagtagagatggatatgaatgtagatagaaatatatatcaggtagaca

SEQ ID NO: 412474 - DNA, 296 bp, Homo sapiens
aaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagag

SEQ ID NO: 412475 - DNA, 741 bp, Homo sapiens
gtccagttttagaaccttcgacaaccccggcaaccacttagctcttttttgtctccacagacttgcctattctagacatgtgatacaaatggaatcataagtatgtggtttttgtgtctggtttctttcatgtttctgaggttcatattgtagtatatatatccatgtttcatttctttttattgctgaataatactccattgaatggatatactacacgttatctatttgcttatccattcatcagttgatggactttttgattattgccactttttggacaccattaataatgctgctataaatattcatactgtttgcatgtatgttttcatatatcttggatatatacttaggaatgaatgctggatcatgtaacaaatttgtatttaacttttcagaagctgccaaactgttttataaagtggctgtacattttacattcctactggcatgagggtttccattttccacatcctcagcaatgtttattattgtcattttgattataaccattgttgcgagtaaaaattggtatctcattaatttgtctttccctcatggttaatgatattgagcttctttttatgtgtttattacccatccatatatcttctttggtatgatgtctgttcagatcttttactcattttaaagttgggtcatttgttttattataaagttacaaaaagttattttttgattatgtgattttttaaataaaaaaattaatagttaaaa

SEQ ID NO: 412476 - DNA, 329 bp, Homo sapiens
cagtgagaagtaaaattctgttgtttaagccacctagtctatggtattttgttatagcagcttgagctaagatgtggatgaaattgatcattttttccacgtgtctattagtcagtcataaaattttttacctttccttttttgtcgtttttgatatttttatgttcccctttccttgattgatttgaatcaatttactatatagttataatattaatcctttgtctttcctatatgtaatatttttcagtatttcatttgcctgtttttacattgtacttatacaaaagtttattttttatgtaataaaatcagttattttatgttta

SEQ ID NO: 412477 - DNA, 1104 bp, Homo sapiens
taaaagacatagactgactttaaataataatttttaaaacctcaactatatgttgtgtacaggaacctcatttcaaatataatgatataggctgagtgtagtggctcatgcttgtaatcccagtgctttgggaggctgaggtgggaggatcgcttgaggccaggagtttgagaccactctggacaacatagtgagaacctgtcccccaaaatccacaaacaaatatagtgatatagataaattaagcataaaaggataaacaataagagcttatgaaccaataatagtaagctggagtagctgtgttaataatggacaaagaagactccagagcaaagaaaatcaattgagacaaagagaaacattaaagaacaataacagggttaattcaccaagaagacataccagttctaagtgtgtttgcactaaacaacacagctttttaagataatgaagcaaaaactaacagggccgaagggagatgcagacaaattcatacttagagttgggtgtgtctcacccctatctccgtatttgatagaaccactagacagagaattaacagaatatagaaaaattgaacagcaccattaaccagtgggatccaattgatattatagatcacccaacaacagcaaggtacacattctttcaagtgcacatggaacatcaccaagacaaactatatcctaggcaataaaactgaccttaacacacttaaatgaattgaaatcatacaatgtatgatctcagaccatgacagaaccaaactagttatcagtaatagaaagataacaggaaaatctggccaggtgtggtggctcttggctcacgcctgtaatcccagcactttgggaagccaaggctgacagctcacttgaagtcagtagtttgagaccagcctggccaacatggggaaaccctgtctctactaaaaatacaaaaattagctgggtgtggtggtgcacgactgtaatcctagctacttgggaggctgaaacaggacaatcactttaactccggaggcagagtttgcagtgagctgagattgggccactgcactacagcctgggcaacagaacaagactctatctcaaaaaaaaa

SEQ ID NO: 412478 - DNA, 573 bp, Homo sapiens
agtataccagagaatgtacatagattatgtgcaaacactgcaccattttatatgagggacttgagcatccgtggattatggtatctgcagaggagtcctggaaccaatcccccatggatacagggggatgactatatattcttattttattattaattcatactgttgcttgacttaattccgtgcaaaataaaattcactttttaaatgttgtgtttgtttgcttttaagtagtaactgtaggctaatgcttttcagtttttcctaaggtgatttattttcccaagtgagaaaggggcactgcttttctttgtttttaatagaaccctctgaaaaaataggtactgaatatcccatttctatgcctttggctttgtttctctatttagaaataaatgcagattatactatgtacttatataactgtgatatctgttttttgtgacaattaagattgtaagattggttttaaaaggattttgaaaaatatttcctttagaaaatgttggaattttcctagctaaattgatacatttaaatggaaaatctctcacacaggtccgagatttaatt

SEQ ID NO: 412479 - DNA, 372 bp, Homo sapiens
tgacctaggtgaggacaggcatttcccaagaccaccctggcctgccatacctccatcttgtgcctataaaaacccgagaccctagcaggcacacacacacacaagtggctggacgttgagagaaatatatcggtggaggaacacacaagtggctggacatcgagaggacatcgagagcatgtcaagagcacaccgatagacttcagcatgccggcaggccattgaccggcagaatgacgtggagttcgaccagggtggttggaggagagcctgggctgctgagcaacccgacgccaggggaaaaccgtctcccttctgtctcccacatctactgagagctacttgcacttaataaaaccttgcactcattct

SEQ ID NO: 412480 - DNA, 497 bp, Homo sapiens
agtgaagtgttaatacatcacatcttatttattttagcaaatcagcatatcttctgtatttaattataaaaattaacttagtttttaaaatttatttgcaaatacactttttccatttgacactatggtttgttgcctacctagctgaatctataatgtcagcttatcctaaggctgtccacatacttaatttacttaagtgttcattttaagtaacgtgctcactgtatataggaatttgtattttggaggtgcttgatctacaaagaaaaattaattaggaattactttattataaaatgctcctagaagtcttaattgtgtttatttttttaaaaaaaataatgttagacttgtgcgcatggaagtaattaaggtacatcatattgtagtttaaaagttgtacatgataagacattttgtttttactgtatgtttttactgaatgatctatcccccatcccaaggcaagcatgaataaaattaagttaaacata

SEQ ID NO: 412481 - DNA, 893 bp, Homo sapiens
aaattatggtggttttgaccataccttattgcttatatattgggaataatttcattacctgctactaggttggtgcaaaagtaattgcagtttatttttgaccattttgaaaattttgaacattttgaattcttggagtatgcaatgaatatcttttgggaaatttcccatggataaagagaaaatcttttttggattcagtgattttagaacatatacatacttcctgctgacaggctaaaagaaaaaaagaacatacaaagcagtatatgaatgagtataaaccactatataagctcttcactctctaactgaagagtaagatatcaaaattatgtatgtgaaatctcatttttctatagaatgaacactgcatcatggattatgttttgatacataattatataaacacttctgtaaataattatgaagtataacacttagaaatgtaacacttctgtccttacatttgggaagaaggaaaaagaaattcatgctagttttgctgttggacctcagaatggctactgactccagcctgggcgacagagttaagactctgtctccaaaaaaaaaaagaaaaaaacaaaaaaaattgtggcggcgtcgcgaccagagaaacgttttcaacaccatctgctgttgggccgcgggcgcccaagtaggtgataatggaacacttggccaacgttgggcccaaggaacccctgggcccagcacaaggtgtggttccacccaaaaaaaaacgcggcgaaccgggttcgaaaatccacaggggtcggggttgtgtctacacggccaggtctatcccgcccgcgcggcgcgagacagagagacgagaaaaacaacatacacgagaatagcaaagacacaaagacaaacacaaagaacag

SEQ ID NO: 412482 - DNA, 471 bp, Homo sapiens
tgggcttgtggacaagaatcttgatttcattccatggtcatcctgtgggggacactgaaggaaaccatgtggccttgtccttgatgtgagtaggtagagtttctaccttccagagaaataccacttaaagcaatggctggacttcctggatgatggaatgataataccggtgggaaataattatcaagtactgactgtgtgctacagcactttatgtacataaattcttttggttgtttttactgtgtgactgttggcaaaacacttaaccctctgtgcaccactgctcccaaatgtaagtgatctcctaaaagtccttttgaactacgaatttctgtggttagcctgggtgcaatggctcacacctatagtcctagcactttgggaggccaaggctggaggattgcttgagcccagaagtttgagaccagcctaggcaacatagtgaaaccccatctctacaaaaaaaaa

SEQ ID NO: 412483 - DNA, 462 bp, Homo sapiens
agaaaaatccagttgtttgtttttgatgggtttctctaggcttcaaggaattaaaaaaatataactagtaaactacctagtgcacagaatactgcgactttaattgttaaatgttcttcagattccttctcaaatttttatctagattgaacaactgggattaagaagaagaaaagacccagctgggtgcggtggctcaagcctgtaatcccagcactttgggaggccgagacgggcagatcacaaggtcaggagatcgagaacatcctggctaacatggtgaaaccccgtctctactaaacgtacaaaaaattagccgggtgtggtggtgcgtgcctatagtcccagctacttgggaggctgaggcaggagaatcgcttgaacccaggaggcagaggttgcagtgggccgagatcctgccactgcactccagcctgggcaacagagcaagactccatctca

SEQ ID NO: 412484 - DNA, 1114 bp, Homo sapiens
ttcacagtggggcttccatgctgtcttttgcagttcttggtggaaagctgggcgcttcagcctgatccaaaactttcaaatcagttccttttacctcttgtaaagctctgttgtcttgcctgtgggaaagcctatgaatagattccagagcccatctctgtcttcctgtggtgtgagtgtgcaggaaagggtgagggcaggagaccagagcagaatgaattttgaagggatgagctgtgtgtttgtttgtgtgtgtgtgtgtacacacacatctcagtgaatttttgaacaagttgctaatattttctgatcatttctcttgaaaaagtgtttattttttttaaaaaaagaggccaggcatggtggctcatgtctgtagtcccagcactttgggaggtcaaggtaggcagatcgtttgagaccagcctgggcagcatcgcgaaatcccatctctacaaaaaatagaaaagttagctgggcgttgtggtgtgcgcctgtggtcccaggtacttgggaggctgaggcaggaggatcacctgagccgaggaggttgaggctgtggtgagctgtgatcacggtgctgcactccatcctggtgggtgacagagaccctgtctccaaaaaaaaaaaaaaacaaaaaacaacacaacaacaaaacccaaccaccatttctgattttgtcttgccttgacatttcactttctgtagtgaaatggtgaacaaattaaaaggtaacaaatttggttttccctgaaatgagttataatagaagtttctagaacagagaaacaaatcttgccttaagtctcactgactgacttgctgtcagtttttattgctccagcgtccccagaaacagtacgtctgcattcagacttgctcaggacagctgcaggctctgcttgtgtgggcagagtgcttctcccatcacagagcataggcactgtgcgttgcaaactgctacattgtaatttgcacaggattttacagctacggtttttaatggttttcacaaatgtatcacattgctgcctctgctacctcccttgtttaatgcttgtcctgtgtcctaagccaaaacttgagaaaagatggaaagaatgatgtatttctt

SEQ ID NO: 412485 - DNA, 433 bp, Homo sapiens
ggaggtaagacaggaaagaggtgagggcacagggtgtctgggagccggatcccacgtgggcagctgggcccgtgctcattgtgggagctggtgcattccttcaccagcccacgctccacagggtcaggatggtcaattccgggcaccccggcctaatccaggacatgctcctgccaccagagaaagcccctaggcagcatcccgggtgctggtggtgtcagaatcaagtttgagtctgaggagtgacctggggctggctgggctaggcagcatcacagggttctgcagcccaactgcacatcaggctggtgacagtcacacagcctattacttcgtgtgtcatcagagcatcgccagaacgcagcacttcaagtatgcagatttagtgagccatagtttaaagacaaatagagccactgaaatcctaaatttc

SEQ ID NO: 412486 - DNA, 281 bp, Homo sapiens
cattatgaaaaatgccaagtgtgtaccaaagtagagagaataatataatgaacgcctacatccccatcacccaatttcaatggttgtcaactcgtggctgggattgtttcatttctacctctacctacttctcttctttccccattggattatgggtgcttgctgaattgttgggcttttaattgtttatttacataactgtttaggggatacagcaaatgctaaaaaaaaataaaacctactcataacctgacttgctttactggagctagtcatccatc

SEQ ID NO: 412487 - DNA, 501 bp, Homo sapiens
ctttcccggctttgtcctttaacacaggaaagaatgtttgggaaagcagcatttattgcattacctggttttaggctacctgcagctaaggctgttaaggcatttcctttgccatgatgtagccataataagagttgggtcactgaggaaaactgaaaacacctgcaggtccaactgggataggagtagattaatgtacaaaaagtagatgcctagccgggcatggtggctcacgcccgtaatcccagcactttgggaagctgaggtgggtggatcacctgacgtcgggagatcgagaccagcctgaccaacgtggagaaaccccgtctctactaaaaatacaaaattagccaggtgtggtggcacaagcctgtaatcccagctattctggaggctgaggcaggagaattgcttgaacctgggaggcggaggttgcagtgagccgagatcgtgccattgcactccagcctgggcaacaagagtgaaactccatctttaaaa

SEQ ID NO: 412488 - DNA, 412 bp, Homo sapiens
tgcgtcgctcacgctgggagctgtagaccggagctgttcctattcggccatcttggctcctccccaaggcctcttctattcctatcttttttaaaacaaaggagtttctcctgtttctaagggagcacttctttttttttttttttttttttttttttgagatggagtctcgctctgtcgccaaggctggagtgcagtggcgcaatctcggcccactgcaacctcctcctcccaggttcaagcgattcttctgcctcagcctcccgagtagctgggattacaggcacgtgccaccatgccaagctaatttttgtgtttttagtagagatggggtttcaccatgttggccaggctggtctcaaattcctgggctcaagtgatccacctgccttggcctcccaaagtgctggga

SEQ ID NO: 412489 - DNA, 457 bp, Homo sapiens
aggtctctctttctcttcttataaaaccaccagttctacttccatgataatctgtcagtggattaatccattcacaagggcagaaccctcatgttccaatcacctgttaaaggccatacctctgaatactgccacattggagattaagtttcaacataagttttggagggaatattcaaaccatagaagttcctttctgtgtatttttatgcatgcatgtacacatgtgtgtagagacacagagaggaccagagaggcagaaaacgcatatatacacctgtacattaaatccatctatgtgcacatatacgaagttgtagaaatagaaccatagtatatatcctcctctataaatttttccacttaatagaacgtgaacatgtttgtaggttcttatatgcagagttacttctttgtatagtattccattgtgtgaataaagcataatttatttagc

SEQ ID NO: 412490 - DNA, 430 bp, Homo sapiens
tcatctgtaaataaaggtaatatctactttgcaaggttctgtgagaattaatatagcagtgttcctggaatataacagaactcaatgaatgtagttccctttcctcatttccttctgtgtcaagggtctttttaaatattatctatcatttgagactgggcacggtggctcctacctgtacccagcacttaggaaggccaaggcaggcagatcgcttgagctcaagagttcaagatcagcctgggcaacatggtgaaactgtctctacaaaaaatatgaaaattatccagggatggtggcacatgtctgtagtcccagcttctcaggaagctgaggtgagaggattgcttgggcctgagaggttgaggctgcagtgagcagtgatcgtgccactacagtccagcctgggtaacagagctagaccctatct

SEQ ID NO: 412491 - DNA, 1322 bp, Homo sapiens
gggcagcgaagcttgtgatcagttgctgcctcttcttgccgttgtttcctttacccctctgcttaccgaaaataattgctgttcttttaatgccaagaagttcccatttataaactgaagttagttagataattaggtagcttagaacagtggcttttaaactttttgattggctctactataaaattcaatttgtattgaaacccatagacatgtgaatgtttatgctgaaacagaagtatttactttctgataataagtgtatgtagtcagatacagtcttttaagtccactttgtatggtacagaacaaatccctaacaagctaattccaacccactaaattgatttaatgatcactgagggttgtcttaccatggtttcaaaacatttagaaggcactactcatgagttgccccatttcagcatatgatccccacttttgctggtctaagaatcatttatcagtcccactcagttatcatatcaaccagatttgttagtgactttaaaaaaacgttaatttgttacttcagcaagtagaagatggatatttttgatgcccagagtgttgtcttccccgtccagggtatctcattctgatcaaaccgaattggccatccatactgagaagtggctattgatatatttatattgagaaatgaatatgtgtttatactttctcccccagatattagagaaactgaagtgggaaacacctttgtagctaccagattatgtattctcttttggaaaagcctcatggaaaacactgctgtgctgtcttccagcttccaggtttcacgaaggcacatctctcaactagtaatatgttctgttttcagaacacacttcagtacatttgattagttcagcatttcccgctgtttgttggggtactaatagatttgtctgcccaaaaaaaaaaaaaaaaagaggtttctttcctaattaaagtgaattaaactggcctttccttgctacaggatttcttaacgtctttagggtgggaatgtgcattggaaatcttagtgatgtgtatataaaatcttcaaagtgccaggtttttgttttttagtgtccacttggggaaatgcttgattagctttccatttcaattatccctttctaaaactgggtcttaagcaaactggaattgagtgtttcccaggtctcttcaaacactttaatatgttggttcccagacttcggtttcagggaactgtaaggttgaaaaagacacattggggtccatcatgagttgaaatttgccaagtaaaggcatttttgaaacttaccatttgttaccatcatttcaaagaa

SEQ ID NO: 412492 - DNA, 1262 bp, Homo sapiens
gggcagcgaagcttgtgatcagttgctgcctcttcttgccgttgtttcctttacccctctgcttaccgaaaataattgctgttcttttaatgccaagaagttcccatttataaactgaagttagttagataattaggtagcttagaacagtggcttttaaactttttgattggctctactataaaattcaatttgtattgaaacccatagacatgtgaatgtttatgctgaaacagaagtatttactttctgataataagtgtatgtagtcagatacagtcttttaagtccactttgtatggtacagaacaaatccctaacaagctaattccaacccactaaattgatttaatgatcactgagggttgtcttaccatggtttcaaaacatttagaaggcactactcatgagttgccccatttcagcatatgatccccacttttgctggtctaagaatcatttatcagtcccactcagttatcatatcaaccagatttgttagtgactttgttgtcttccccgtccagggtatctcattctgatcaaaccgaattggccatccatactgagaagtggctattgatatatttatattgagaaatgaatatgtgtttatactttctcccccagatattagagaaactgaagtgggaaacacctttgtagctaccagattatgtattctcttttggaaaagcctcatggaaaacactgctgtgctgtcttccagcttccaggtttcacgaaggcacatctctcaactagtaatatgttctgttttcagaacacacttcagtacatttgattagttcagcatttcccgctgtttgttggggtactaatagatttgtctgcccaaaaaaaaaaaaaaaaagaggtttctttcctaattaaagtgaattaaactggcctttccttgctacaggatttcttaacgtctttagggtgggaatgtgcattggaaatcttagtgatgtgtatataaaatcttcaaagtgccaggtttttgttttttagtgtccacttggggaaatgcttgattagctttccatttcaattatccctttctaaaactgggtcttaagcaaactggaattgagtgtttcccaggtctcttcaaacactttaatatgttggttcccagacttcggtttcagggaactgtaaggttgaaaaagacacattggggtccatcatgagttgaaatttgccaagtaaaggcatttttgaaacttaccatttgttaccatcatttcaaagaa

SEQ ID NO: 412493 - DNA, 458 bp, Homo sapiens
acaatctcttgtgattgtctgctctataatactcatatattggtatactgttaaacctccccttttggcttaaaattagaagctctttaggtattctgggggagggggcattagagggtttaatagaggaattagggtttgcatgtatgtttaaaagctggatgagagaaggttaacagagtcactgccaaaggccaggagagcttgtcaaagagaatcagagatggacagtacttaaagcagtaaaaacagattatattcagacactattgcagtatggaaaatagacctcattatagaactaggctcaattctgaatacagcatgaacaagttgagatttatagctaaggagggtaggggtcagtggatggaaaattactaagaggaaacataaggaataaggggaattttggttaaattgatctaacaggattcttactgaaggcaggccagggc

SEQ ID NO: 412494 - DNA, 509 bp, Homo sapiens
ggattattttgagaagagggcatgccagagtggatggtctatgtgtggccagaaaacctatcagttgactgtgtccctcagaaatgcctgtaagacatttcatttaccaaaacaataaagagtgccagtgatggcactggtgtcattggaaactcagtggttgctctgtactccagagctgatggcaaaacatgctgttgcagaactgagctgcctgacagtaatggggatgaaaggtcttgtaataatagagggcatgcacttagccttcagaaataaggtgagtgcaattattataatgagcagcaaggtcagggtggcagtggtgaggagaggaggatcatctggagagagctatggagaagattaatagaatatggattccctagggggaagtagatggacagcaaaaaaaagtattgctcaatctataaacctgtgaattatgtcaagtaaaataaatgtattactcaatctgtacaatcaaaagaaatcaaagatagataatg

SEQ ID NO: 412495 - DNA, 429 bp, Homo sapiens
gaaaattttttaacctttagaaatcctcaacccatttggaaataagttcatgagttaaaaaaaaaaaacccccaaaggaaataagaaaattttttggaatgaaaacccataaaaagtcatcagatagaaataaagcagtcctcagaggaaaatttacagcattaaacatttaggaaaaaaatattgatgagctaaaccagggatcaaactatggcccacagcccatttttgtaaataattttttattgcaatttaacaatgtctcatcattgacttattgtctatggatgtttcatgctataagggcagagttgagtaactgtgggagaggctatttggtccactaaggctaaaatattaattggccttttacagaaaaagtttgctgacccctaacctaagcttccattgtaagaaattagaaaaaaa

SEQ ID NO: 412496 - DNA, 420 bp, Homo sapiens
aaccccaccactatgtaatatatccatattacaaacttgctcatgtatcccctgaatctaaaataaaataaaaattaaatatatgaaaaggtgcattttactttatgtaaaatttatcttacaaatgtataaacaatattgaactcccagttatattgatttatgatgacatatttagaagtaaagtgtattggtagctaaaactttgaaatgaataaaaaaaaggaattgatgtttggttaggtttatagagaaatggatattgtgtaatatttcatagttggtactcttcaaagttaacaatattagcaattgatgctaaaataattattcttttatatcatattcaaatttcttatattataaaagaattacattatcaccaatatcagtagattcattaaagttgcaataacaaac

SEQ ID NO: 412497 - DNA, 414 bp, Homo sapiens
tgaatgcctttccctgatattgaaaacaaggcaaaggctatctgccctcaccactcttattcaatatggtgctagaattcctatcctgtgtaataagaaaaggagaaataaacaccaaacagattagaaaggaagaagtaaaactgtccctatttgaagatgacatgattgtatacatagaaaatcctaaggattcaaccaaaagctactataactaagtgaatttaacaagcttttaggatacaaaaatgaatgcccaaaataaattgtatttctacaggctaacaatgaatacatggtcagcaaaatttaaaatcaatacaatatcatttaaaatttctcaaaaaagatatatacttaagcacaaacatcaaacaatgtatacaggacttatatgctgaaaacatgttgctg

SEQ ID NO: 412498 - DNA, 447 bp, Homo sapiens
ccacaacttattcatatgacctaaggtagctgcaaggaatgctgcgacacatgttcttttagctatgcagcagcttgcccagctaaatgttgatattctattactgaaagagagggcagacggaaactggagcaggcactcagcactcttgtggccacacagcctagtgcggagagaacttttagtcttcattctgttattgatttaccttcttggtgtatattttgtatgttgcttttaaaatgagttctttctttctttagtttcatttgaaaggaagaagtaatacatgaacttggtaagaaattcaagtagtacaaaggatatacgataaaaataagtcccttagtctctttgtattagctaggacttttgggatcatgaatgatagaaaacctaactcaatctggcataaagaagaaataaaatgtattggtctatgcaatt

SEQ ID NO: 412499 - DNA, 430 bp, Homo sapiens
atcaacacaatacttaagaataaaaacaaagttggaggactgatactactgaacttcaagatttactataaagatatagtaattaagatagcatggggattgggagataagggagatgttggtcaaaggacacaaaatttggcatgagggctcatgcatgtaatcccagtactctgggaggccaaggtgggcagatcgcttgaggccaggagtttgagaccagcctggccaacatgacaaaaccctgcctctactaaaaatacaaaaattagccaagtgtggaggcacacacctgtagtcccagcaacttgggaagatggggcatgagaatcacttgaacccaggaggtggaagttgtagtgaaccaaaatcgcaccactgcactccagcctggaggacagagtgagactgtctaaaaaaaaaataaatt

SEQ ID NO: 412500 - DNA, 448 bp, Homo sapiens
aagaacacatattcaaagtaagcagaataaaggagataataaaggtaaaagcagaaatcatgagacttcagaaaacaaaaacaacagaaaaaaaccagtaagtccaaaagctgtttctttgaaaatatcagtaaaattaagaaacctctactagactaattgggaacaatagagaaaagaaacaagttaacaatgccaggaataagataggtgactataaacacattaaaagaatgataagaaaatattatgaacaactttatgcttaaacatttcacaacttggatcaaataaatttcttgaaagacacaactaccaaagctcactcaagaagaaataagtggcctgaatagcctaacatctactttttaaaaataatttatagttaaaaaaaaaactgcccacaaagaaaactccaggcccagatcactggtgaattctaccaaac

SEQ ID NO: 412501 - DNA, 485 bp, Homo sapiens
agcctggaagtagacatttttttattaaccaaaatgaatttagttagctcaccattgcctctacaaaaattgtactgggaccaaaaactttgtatatgagacaacaaattttctaaaatgcaaatcttaaagacaaataatgttagtgtccagaagaaaggttattgggtcagtctttcagattatttccccataacaccaagttccaaaaaacaatttctagtcatttgtgggatgctccagagagcccttgggacaagtaaagttgcagctgtttgtgtgtgttgtaattcaagatgatgtgttgctacatctactagtttggtacaactgttatgatcagatagacctagttccttaaggctgagacacaacagtctggtttctgtaatggaaggatgagtaggctttattctgttttgttgctttttttctttctttcttttaaataatacattctaagcctcgatcctggactttgcagg

SEQ ID NO: 412502 - DNA, 815 bp, Homo sapiens
gggattacaggcataagccactgtgcccggcctggaaagtcttttccttgttctgtacctatcaaaatcttacatccaggtcaggcgcggtggctcacgcctgtagtctcagcattttgggaggctgaggtgggtggatgatttgaggtcaggagttcaagaccagcctggccaacttggtgaaacttcacgtctaccgaaaatacaaaaattagcccagcatcatggcgcatgcctctggtaccagctgctcaggaggctgaggcaggagaattgcttgaactcgggaggtagaggttgaagtgagcccagattgccccactgcactccagcctgggcaacagagtgagattctgtcttaaaaaaaaaaaaaagtgcatcctcttcaaggtgcaatccaactgttaccctttggcttttacaggtacctgtaaggagttgatgtgcaccttctttgtgctcacatagtgcttgtttatgtttttctagttgcactgtcacatcatgttagaattagcagtcagtgaatctgcttgcctccatagctatgaactctatctagtagctatacctgttacctcagtgtctgacacatggtcttgtacatagtagcactcaatgtgtgaacacaacgcaaatgtaaacgcactggtgacatcatctctaaacagagtggaaacctttgctagcctcaggtgcacaatccttcccctacctcacctcccgctgcaatgtgtgtcttgtaggagttaatttaggataatctctgaggtcatctccaggtaatcagcatctccaggaatcggcagggtaat

SEQ ID NO: 412503 - DNA, 1000 bp, Homo sapiens
cagcacacaagagagatcagctgccctcatgaacagaggtgcctatatgcagctgtgatgttctgcctacattttttttctttctccacattaacctggtctcccaactttgctaatgaaaaaaaaaatagaataatacctttctcttcttttggctcagatagaaagaaattaacagaagccacacattcttttccagagctcaatgaagctatcgatatcagactaattgatttcgttcatgcattcactcattcatttaatcaacaattgttttagtggcctctatgtgccagtcactattctgggaactgggaacccagcagtcaacagggaaagttccagcttaagtattagtggaaggaaataaactagtagaaggaaagtgccacaaataaaattacacagagaatcccatctacaatagctacaaaaattaaaatacttaggaataaagttaaccaaaaaaataaaagaaataaacactggaaactctaaaatattaaggaaagaaattgaagaagacataaataaatggagagatagactgtgttcatgtattggaagaattaatattgttaaaatgttcatgctacccaatgtgacctatagattcagtgcagtctctattaaaatttcaatgtcatttttcatagaaattagaaaagtttctaaaactcatatggaaccacaaaaattcccaaataagccaaggcaattctaagccaaaagaacaaagctggatgtatcacactacctaattcaaaattatactacaaatactaatttaaaagcatggttctggcataaaaatagacacattgtcaatacattaaaaactttgtgttgtacatgtcaaaaaaatgtactttataaaaaataaaaaaaatttaaaaatacacacattgaccaatggaacagaatagaggcccagaaaaaagctcacgtatgtacattgattttcaacaaaggtgccaacaacatacaatgggaaaagaat

SEQ ID NO: 412504 - DNA, 496 bp, Homo sapiens
tttttgagatggagtctcactctgttgcccaggctgaagtgcagtggtgagatcttggctcactgcaacctctgcctcccaggatcaagcaatccttgtgcctcagcatcttaagtagctgggattaaaggcgtgtgccaccatgcctagcgaaattttgtatttttagtagagacagagtttcaccatgttggccagtctggtcttgaactcctgacctcagtgatcttctcgcctaggcctcccaaaatgctgggaggcgtgcaccaccacgcccagcccttctgtatcttgttggtggtggtgattaccagaatccatgcgggggataaaacagcccagagctctgcaaacacacgttgctccgcgtcacctccctggttttgggattgacttacctaagacgcaaccacaggaggaaactgggtgaagagcacacgggacctctcagtgccacctttgcaacttcctgtgaacctactattatttcaaaaga

SEQ ID NO: 412505 - DNA, 425 bp, Homo sapiens
tctgaagacatcccagagcaggaaacatggagcgtgggtgggcacccacaatctccctgacataggagtcaagctggctctatggattgagccctgcttccctgcctgacaacatctctggaagcaaagcagcaaacttccataggcttcatgttctcctcaaatacccatggtagccaccccatggtatgaagagtggcaacacgtctggtctaagtcgggaaactgacaccctcagtgtcaccatcatttcaactcaaggggtccattcacctccttcccagcacattctgatagcctctgcagagacggcaccctcagacttcaattcttgatccctaccactttataactacaatttcttttgcatttgtaaaatgcagatttaaaactagagaatacatttcatttcaaggaaacctaga

SEQ ID NO: 412506 - DNA, 457 bp, Homo sapiens
aattgcttctttgctgattttagaaagttctgtttgtatttctgaaagtaaggcaagaaacaaagagaatagaagaaatttaagggaaataaggtaatatatgtgaaggtgccttgtaaactgctaaatcacattacagcaagtgttgaacttaaagtgagaaaataagatccacaaagatgctataaagaaaaatgggagaaagagaaaagaacttagataggaagttgttaagaagaaacaaaatgggaaaatcataatggggaatttttacattctaggttttttttactctgaaaattcaggagtagttgttcttgctatatgagcagtgaagtaaaaaatattttttagccgagaagaatgttctgtggaaataattgggaaaaagaatcttatctggggtggtgaaagttggatagaaactactaggcacaagacctagtctaaaaaaagg

SEQ ID NO: 412507 - DNA, 417 bp, Homo sapiens
ccagaatgcttttgcgagagctatggtccttctaaagcagcataccactcagaagtgcaaaaatgaaaattaaaataggaagattttcttcttattattatttgaatgacatacgacctgctcgatgtttgcatttaaattgagcagaataattcagctctggcttttaatttcagaagggttaatcaccctaacaaaggtcaatcaaactttaatcttcaataaaattgctacagccccaatcacctgcaggacatttattatattcccatttccatgtgaaagaatgcattgctttcattatgtatcactaatcttctcactctttacattagcacattttaccaaaaaacgttaattcctttgaaactctgacaagagttcatttctacacatctcaggagataatcctgttta

SEQ ID NO: 412508 - DNA, 335 bp, Homo sapiens
ttcttctgaactactgagaatactatctgttctttgaaaatgaaaaaactggccaggcatggtagctcacatctgtaatcccagcactttgggaggctgaggcaggtggatcacctgaggtcaggagttcaagaccagcccaatcaacttggtgaaaccctgtctctactaaaaatacaaaaaaattcaccaagcatggtggcacatgcctgtaatcccagttactcaggaggctaaagcaggaaaatagcttgaaccaaggaggcagaagttgcagtgagccaagatcacaccactgcactccagcctgggcaacagagcgagacaccatctca

SEQ ID NO: 412509 - DNA, 486 bp, Homo sapiens
acaactgaatcatgggggcagttttccccatactgttctcgtggtagtgagtaactctcacgaaatctgatggttttataaggggaactcccttttgcttggctttcattctgtcttgcctgctgccatgtaagatgtgcctttcgccttatgccattattctgaggcctccccagccacgtggaattgtgagtcccttaaacctctttttgtttataaatcacccagtcttgggtacacctttatcagcagtgtgaaaatggactaatacagtaatcttgcaagcctgcacaaacttgcgctttgtataaaaagccacaataataaaacttgttgagaatatcctaccaaaattactatgaaagttatctctcccttttactatgagcagaggtggcccattagaataatatggttgtctctggattatgtataataagaaaatgtgtgtatacaaataaaatgcatttattatgaagtaaattt

SEQ ID NO: 412510 - DNA, 305 bp, Homo sapiens
ccaagaaacaccaaggcttgcctgcagccaccacaagttaggagggatgcacagaatagattttctctcagaggatctagaacgaacgactttgccaataccttaatttcaaacttatggctctcaggactgtgagagaaaaatgtctgctcttttaagccactctgtggtatttagttatggcagacctagcagactaatataccatatattctcattctttcatagtctttattggttgctttcccccttatgactaaagtaataaatatcaatcatagaacttttataaaatacaactatgc

SEQ ID NO: 412511 - DNA, 307 bp, Homo sapiens
caaaccatatctccaagatacatcagggcatttctcaacactaaagtttgaagatgcgagtagcagagggatggctctaagacaagccagaacatcagcaaatttgatgaccagttcacctgactttgaaaactgcctattaaaacctaaaatatttatttctgaatcagagaacttgggggtaagtgtattcaaattggaggtaatttggatctgaaaacttttaaaaaccaaatgggtcttgaaaaaattcaaattgttgaataacttttaaaatctttagctcaacagtattaatagtgtaaat

SEQ ID NO: 412512 - DNA, 407 bp, Homo sapiens
ggcaggtgtcgtgatgaagatgctgataacccaccagtggtgctcggcaatgtttcaggacgttgaaggtttgtgcaaagggtgcaatgttgcaagtgggttcagacgtagaaaagaataggacaggccaggcacagtggctcacacctgtaatcccagcactttggggggcccgaggcaggtggatcacctgaggtcaggagtttgacaccagtctgaccagcatggcaaaaccatctctactaaaaatacaaaaattagctggttgtggtggcgggcgcctgtagtcccagctactcaggaggctgaggcaggagaattgattgaacttaggaggcggaggttgcagtgagccaagatcacatcactgcattccagcctgggtgacagaccgagactctgtctca

SEQ ID NO: 412513 - DNA, 360 bp, Homo sapiens
ttattggcgtttttaaacctatgatcagtggtaagtgagggcatttgcccagaatttctcaaaaaattacctcagttgaggccgggtgtggtggctcacgcctgtgatcccagcactttgggaggctgaggcgggtggatcacgaggtgaggagatcgagaccatcctggtcaacatggtgaaaccccatctcttataaaaatacaaaaattagccgggcatggtggtgtgtgcctgtaatcccagttacttgggaggctgagacaggagaatcgcttgaacccggaaggtggaggttgcagtaattcaaaatggcgccattgcatttccagcctgggctacagagagagattccatctc

SEQ ID NO: 412514 - DNA, 379 bp, Homo sapiens
gcagagcaggtggtctcagtgtggtttgatggaggagcaaaggcattccagattcagaacagcttcctgttctgctcacagcagcctcaaagtcgattgaaagtttctggcaaaatacaaattatttcctgggaggaggtaagagaatggattaatttacttagtttcctagttgagaatttcccaaggtactgggactcagagcagatgtgtcattattggtggggaggggaggtaaaggaaagtctggctcgattattctcagctgcgacccgggactgtggcggggcttgcacacactcacagctccttctggagacctccgcccgcttatctttgggggcctgtggtccctgcctggcccactgttctggcgaac

SEQ ID NO: 412515 - DNA, 314 bp, Homo sapiens
agcagggaccagggcatcgagctcttgtagcagccccagcacaaactggaaattcttttctaaaaacgtagccagctgggcgcggtggtggccgggcgcggaggctcacgcctgtaatcccagccacctttccaggagtcccgggctcccaggcgccatctgcaccggtcccggtgctcccgctgggtccgccagcttctcagcgggcagcatcgctcccaaagggaccaaaaggctttggatggaacaaccctgtgtccctccggatgctgatgatcgaatggtttagcgccaggttccccacgaacgtgcgg

SEQ ID NO: 412516 - DNA, 455 bp, Homo sapiens
attttctagaaaagagtaatccatgcagaaaaaatagcgtgtgtaaccacccataagcattatactcataagtgagaaatccataggttattaagtatggaagtttgggaaagtcgaagttgatgctgtaaagtgtagtcaaattttgaagagcaatatatgacatgttaaagattttgaaacttgggcgtgtgcagtggctcatgggcccgagtgaggcgggaggctgaggtgggaggattgcttgagtgcaggagttggagaccagcctaggcaacataatgagacctcttctctacaaaaaataaacaaaattagcttggcatgatggcatgtgcctgtagccccagctacccaggaggctggggttgagcctgggaggttgaggctggagtgaaatgagattgtgccactgtgctccagcctgggcaatggagccagaccttgtctcaaat

SEQ ID NO: 412517 - DNA, 319 bp, Homo sapiens
acaccaacctgttaagagataggtaatataaaaatatatagtttgagacaactaaatcaaaatggaggaggggatagagttcaagaagtagaatttttttgcgtgtgcttttcttggcctttgtttgcttctattcttttatttggaatcaaagataagttatcaactctttaaaataacttgttatatgtataagatgttttctgtaagcctcatggtaaccacagtacaaaaacctatagtacaattcctaaaaataaaatacaaaaaaattaaaatatactaccagagagaatccttagccgcaaaggaagaaaat

SEQ ID NO: 412518 - DNA, 446 bp, Homo sapiens
agcacatacacatgtactcatggagaagaacaccgctttaaaggagtaactagttgcaacttgttatgttatttccaatcttgatctatgtgcctatggttttagatcgttgcggtcaacatgttgaatatttcatgagtgaccccagacaaaccacttcacctccactcatctattttcttatcagcaaatggagataattgcttttgtttcacagggctgttatgaaaatcaagtgaagtaagataatacaaaaacaattcgtaaactctaaagtatacaattatgagacatttagtgacacgtaattgcttctgttatgtttttctatgtatcacttgtaacagttgcatattactctgagttgctgtcatagtttgtttaaccattatctacttgttactcatccttgctttttgctatcataaataaagttggttataaac

SEQ ID NO: 412519 - DNA, 440 bp, Homo sapiens
cgttcatccattcatctgtccatctactcatccatcatccaatcacttactcacccagcaagtaccaattgggagcctcctatggatgaggaaccctatcaaatgctgaggggcatggaattccgcggcagtgcctcctcctctccaagactggctatgatatggaaagtcgtggccacacaccatgccactggtgggcattccagtggctggcagagcagctgtgccccagggctgtcatccactaaggcctctctcagtgtccatgggcattttgaggactccagggctttgtcctttcacctcttatttattggttctatgccactgtctctaccgtacataggcctccctctttccttttgtttcctctgtatttcctcctctcccttctagtcttttgttccactggaaagagtggaaaaattaaatgattttaa

SEQ ID NO: 412520 - DNA, 975 bp, Homo sapiens
ctaatgagcatcatagagatgtggaggacataagaacaggatattgagagaaagatcagagaggaccagaccagaggcatttctgaccctttctggagtctggagaaaggttctaacagttcatccctcatacaggatgataggcattaatgctagatccacatgcaatagtaattctagtctgtggttttatggacatttaaattattgttttgtctagatgggttcagtcattaatcttttatgttttctgagtggcatccagagctaaaagaatttttccaagcattgcttaagataaatctgaggccaggtgggacacaactgacatttcggctaagagactgatgtctaagagagctgaccagtgagatgcctgtggtagattaaagacaaccacaaattctttacttttcctttcatcaaaaaagtggagcattttccatcccctggagcctgagctggccatcacttgcttgatccatagaattcagaagcagtggtattctagaacttccaaggctaggttatagaagtcttgtagcttctgccatgcctcttagaagactcaatctgagagaagccaacaacatgtaagtctcactactctgagactgccatcctgtgaggaatcccaagctagatgagcagagatgccttgtggaaggagaacaatgaccagctagcccaagctgctccagctgttgcaaccaaggcaccagacatggaagcgaaaaagtcactttggacattgcaaccccagcagacgtgacatggagaaaaactgagaaacccaactgatatttggaaacatagcctcagatatatatccccagttgaactgttccatccatctccagccatgtgagccatcccagtcatcagggaacagagatgagctgttccctctgagctctgtccaaattcctgacctgcaaaatcttaagcgtaataaatgttatttaatgccactaa

SEQ ID NO: 412521 - DNA, 359 bp, Homo sapiens
aagagcctgtgttgtggtttctgcagaaattaatgtgccagacagcaggtaagcaggtttgggattgactaatttgaattttgatgggccctggggtctaggtgctatccctggttgtctggtacctggccctggggtgattagggctgagtgtgagagccctataaaaaggtgcttgaggtgtgggctctggattggttggtttgcatatgaaagacgtgttctcaggcaagttgtttgctatctccaggaattagcaaactctgggaggggcagtccagggtcagtacagccccaagatgtcaagtcatcagaaaacaaaaggcatggttaatataatataaaaatgattccaagca

SEQ ID NO: 412522 - DNA, 270 bp, Homo sapiens
aggtggggtttcaccatgttggccaggctggtcttgaactcctgagctcaagtgatccacccacctcagcctcccaagatgctgggattataggtgtaagccactgtacccagcctgcattagtgaattctttataactcaaaaaaagataactccctcattaaatgatcgaaagcatggaatggggggaagaggagctatataatttatttcatgatttaatggaattttggccctaaaacataaaagataatacagcttaaattttta

SEQ ID NO: 412523 - DNA, 259 bp, Homo sapiens
gatggggcagccagaaggagcttcaggaacccttctttctgttcatgctggaagtggacccacaagtgggagtctgtgattgatacgtggtgttgagaatatcaggtctccatgcagagaaaaaaatcttcaaatagaataaaatgcaaccatgaaaggcagaactgaaaaaagatgttagtagaaaatgaaggagaatatctttttctatcctatagataactctaaaattcaaaaattaaacaaacaaaacaaaaat

SEQ ID NO: 412524 - DNA, 444 bp, Homo sapiens
aattaattccagcactcagtataatgaccctatgtctaggagaagagccatttcatattatgaatgcagcagttacaacaggtctgccttaagtcgcttgctctgtgagcctgacaaattatttactgctaacaaaactactgcggtatctggaatgcatccgattttttaaaaaaataattttcatcccagcattttgggaggctaaggtgggtggatcacttgaggccaggcgtttgagaccaccagcctgggcaacatggtgaaaccccatatctactaaaaatataaaaattagctggatatggtggcacatgcctgtagtcccagcttctcgagtggctgaggtacaagaatcactggaacccaggaagcggaggttgcagcgagccgagatcgcacccctgcactctagcctgggcaacagagcaaaggttctgtgtc

SEQ ID NO: 412525 - DNA, 306 bp, Homo sapiens
tctgtactctagaaaagcaagtcccttccttttgtgggcttaatttcctcctgtataaaatgaggagctgaggccaggtgtggtggctcatgcctgtaatcccagcactttgggaggccatggcgggaggattgcttgagcccaggaatttgagaccagcctgggaaacatagtgagaccctgtctctataaaaataaaaaaaaatagctgggtgtggtggcatgcaactgtagtcccagctacttggaaggctaaggtgggaggatcacttgggcccaggaggtcaaggcttcagtgagctgtga

SEQ ID NO: 412526 - DNA, 456 bp, Homo sapiens
caaaatgctggaattacaggcatgagccactgcgcccagccagacgctgaatttttaacaagtgctgcaacttgattttctgcatgtttctcagactactcacactctgggaaatattgacttatgggaaatgccaaaatttttccaaaagatattcggggccctgtgtgatctttaagccacttttctttctgctcttctgcattcactctattgtccagtcacacggactcccctatctatgttcaaatatgcagcttttttccccatctccctgccttggcacaggagaaacatggctgccctctgcccagggcaccttccttcctcacttgctctgcctggaaagcctgtgctcaccttccgggcccccattcacccagcctccactgggatgcctccctgcctgtctggtgggacagccacgcacttccctgcttccctctgatcccttta

SEQ ID NO: 412527 - DNA, 437 bp, Homo sapiens
aaatctttagattccccctgtaaatataattattttctgtgacttacaaatgaatacacgaggctccggttaaacattgcgcacagagtgtagttgaaagggtgcacactcctccgttgacattctggctctgcccttgttccctgtgtgaccacaggcaagttacttaacctccctgagcctcaatttcctcactggtaaaatgggtcagtggctgacacacagatcgggctagtcctaggtatggccagctgtgctcttcccaccatgtgcagtggctcacacctgtaatcccagcactttgggaggccgaggcgggcggatcacctgaggctaagtcaggagaatcaattgatcccgggaggcagaggttgcagcgagccaagatcgcaccactgcattccagcctgggcgacagagcaagactccgtctcaaa

SEQ ID NO: 412528 - DNA, 536 bp, Homo sapiens
tacggagtttgtatgcatattgaagacaaaaagtgctgctctctaggcttcattggagttcctcatgttgccatgatcagcatataatagaggaatcggtttctgtgttagcatttattaatatgttgaaagtagttggtgactggataattttgtagtatagttattaaaaatctacatgaaaattcacctatttatgatttttaagttcctaattctctttaaattatgtcaaatactaagtgttcttaatcagattcctcatagttttaaggattaatgtacatgtaaattatctttctcccttggttttaattttaaattttacatatggtttacattttttatactttgtttatcaaaaaacaattttgtggaaattttcttttgtttagtgtttttagtaagttttgaattgctaatgttatcagtttgataccgttcaagatacaacaccttttttcctagaaatcagtttgataagcaaaagcaaattactcaagtaaatgtcttgtattacccatgtccagtgcaaa

SEQ ID NO: 412529 - DNA, 512 bp, Homo sapiens
agcctgggcaacatagggaggccatgtctctaaaaaatattaaaaatgacatcttttaacagcctgattgaccattagtagtggtgatgtatgtacagtaaggctcatctcacctcaaactctttgatgtggaattctagtttgacagcagtttgcatctgtgtacattttccttagcagtgtaggttgcttttctgagtcttgcaaatcatttttactcagaaaatttacaaagaggaatctgaggtttggaagagaaaagggaaggaaagtggcaaaatggaagtgaagtttttaagtgaatcctgggaggaggcagaggaagctaacacccacagagagagctgagggtgatagccttgtatctagagcaacgcccaaacagcagtgcaaatcgatgattactgagggcatccttgaggcattagtgggaccgaagaggtggatgttacccacttccagcctaaaattaaaaggacattgaatatttgggtgacagtttagatgtagga

SEQ ID NO: 412530 - DNA, 467 bp, Homo sapiens
taataacgtgtcagtagtcataaactacagataccgataaggagatggcatttcaggagagaaaagacaaattgtcatctgagaccatgagggcagatatttactaataaatgtaaaaaatgtgaggcagcagagtgtagtactgtatgaagagagagactctgtagccagccctgaagggctgcattcagacggcagggattgaattctgattgccacttagcagctctgtgaccttgggcaggttactcagtgtctgtcccaccagttcctcatctgtcaaatatatgcaataaaagtgcacaattcagtgggttagtgtgaggattagagtatttgcaaagcatgtaggacaatgggggaaatgctgatagggatccaaatgctgtatatcagtagagaaatgaagagtttttaagtacagtttctacatcaaatgtaatgtaagaagattgcttggacttgcg

SEQ ID NO: 412531 - DNA, 383 bp, Homo sapiens
ggctgaggcaggagaattgcttgaacccaggaggtggaggttgcagtgagccaagatctcgccactgcactccagcctgggcgacagagcgagactctgtctcagggggaaaaaaaagaattttgaaccccccaaaatatcacatatctagcagttctaggttccagggtggatatttttaacatatgtttgcatttggttctgggatagtaaccgttatggataattgtttgtttctgtcaagtcggtgagattttaattgtttgaattatttctatttaaaattactctcaatttaactgtttaaaaaactaaaaatttaaaacataatggcacaacatacgacacagaataaaacacatgttttcaaggaagaagaaaaa

SEQ ID NO: 412532 - DNA, 429 bp, Homo sapiens
gagaccaagtctcattctgtcgcccagctggagtgcagtggcatgatctcggctcactgcacctccgttccctgggttcaagcgattctcctgcttcagcctcccgagtagctgggcttacaggcacaaaccaccacgcccagctaatttttgtatttttagtagaaatttttttagtggaaaactttagtagaatttttttatttttgtacttttagtttcaccatgttgacaccaggctggtctcaaactcctgacttcaagtgatccacccgccttggcctcccagagtgctgggattacaggtgtgagacacctcgcccagccaagaaaaacactttcaactttcaaagccactgtcatttggtggggctctttgttacagtcactatattcaaataaggagtcaatagtaatccacagaaataa

SEQ ID NO: 412533 - DNA, 497 bp, Homo sapiens
actctataaagaaatgttagtttaatgctaggtgcggtggctcaatgtttttcagtgtgagtaaaatatttacaaagcttagatttatatcctgagaaataatgtttcattttataaatattaataggttcttaaatttttcagttttctgttttataaaatttagaaaatatgaagaacctcagcctctaaaaatatatttttggccaggcgtggtggctcacgcctgtaaccccagcatgttgggaggccgaggcaggtggatcacaaggtcaggagttcgagacgagcctggccaacatggtgaaaccctgtctctactaaaaatacaaaaattagccagtcacagtggtgggcacctgtagggacagctactcgagagcctgaggcaggagaatcgcttgaacccgggaggcagaggttgaagtgggtggaggtcatgccactgctctccagcctgggtgacagagcaagactccatctcaaaaattaaaaaa

SEQ ID NO: 412534 - DNA, 752 bp, Homo sapiens
cgggataggcctgtggggtcagaggtaggagaattagattttgccttcattgtctgaactgtttttgttttaaaactatatatattactattagaaagtcattaaaaaatagagataattggctgggcgaggtggcttatgtctgtaatcccagcactttgggaggctgaggcgggtggatcacctgaggttgggagttcaagaccagcctgaccaacatggagaaaccctgtctctactaaaaatacaaaattagcttggcgtagtgatgcatgccagtaatcccagctacttgggaggttgaggcaggagaatcacttgaacccaggagacggagtttgtggtgagccgagatcacaccattgcactccagcctgggcaacaacagtgagactccatctaaaaaaaaaacaaacaaacaaaaagataattaatagatgcactttttattttaaaattttgtgggtacattgtaggtgtatacatttatggggtacatgagatatttttgatacatgcatgcaatgcatattaatcacatcggggtaaatgggatatccgtcccctcaagcatttatcctttgtgttacaaacaattcagttgtttattttaaaatgtacactaaatgattgttgactgtagtcacccttttatgctattaaatactagatcttattcattctaactacacttttacattttgaaacatagtgaaaatgtcatacttgatattagagtgaattattcagtg

SEQ ID NO: 412535 - DNA, 333 bp, Homo sapiens
gtgaacctaagaaacagtggtttcatccaaaaaagattgctcagacctggcatggtggctcacacctgtaatcccagcactcttgggaggctgaagtgggtggattgcctgagcttaggagttcgagaccatcctgggcaacatggtgaaaccccgtctgtacaaaaaacacaaaaattagctgggcgtggtggcatgcatctgaggtctcagctactcaggaggctgaggtgggaggataacttgagcctgggaagcagaggttgcagtgagccaagatcataccactgccctccagcctgggtgactgagcgagaccccatctcaaaaaaa

SEQ ID NO: 412536 - DNA, 372 bp, Homo sapiens
atattgttaaatcaaatttagcctaaagctgcctccttatatagtttaagcttgacctaaaggtttctctgtacttagtgaattgtagcctacccagatgtgtaaacaagactgtgaactactcttgtgacaaacattggattttggccaatcaaaggaggtcaactcttgacactgctttcaaataaggcaaatattgagctgtaaacaatctggctgtttctatacctcacttctgttttctgtacgccacttttctgtctctgtccataaatgttcttccaccacgtggctgtgctggagtctctgaacctactctggctgaggaggctgcccaattctcaaactgttcaattaaactcggttaaattt

SEQ ID NO: 412537 - DNA, 200 bp, Homo sapiens
agtcacctccagttttatttattggggatcagctgagaatatcgaataattcaatttggaaaaattcagcagcttacagctggcccaaatgggttgcatgtgggcagagtggagtggcaggaccacagcgcatagccagggctctggtgtcagttccttgttagatgtctgaccttgacagagcgagatcttattaaaaa

SEQ ID NO: 412538 - DNA, 438 bp, Homo sapiens
atttagatataaatatatgagcaaggtttacagataatgactctgatttcagtttttgacacactaatgttgagactcttcagtaacttgcaagagcagaccaacaaatgggcagttggatctgacagcccagaggcagcagaaagctttggacggaagataaagtaatagtaaacattatgcagcacttcaaataggatgtatccactacacggtgggaaacagtaatactccggagaacctctccacacagttaaaaggaagggttacatcacacaccgggttctgtcctggggtgggatgaggggggagggaaagcattaggagatatacctaatgtaaatgatgagttaatgggtgcagcacaccaacatggcacatgtatacatatgtaacaaacctgcacgttgtgcacatgtaccctagaacttaaagtat

SEQ ID NO: 412539 - DNA, 475 bp, Homo sapiens
attagcagactaggatagattctagggaattggtttttttggaagtttttagacttacctatatatgtttagaagggagcctgcttaaaggtaaaggaatgaggaagataataattggggagcccttttaacaatgggcctgtgtgtagtgggtaagctgggggagttatatgtgaaagtatctctgtcgggcgcagtgcagtggctcatgcctgtaatcctagcactttgggaggctgaggtgggcggatcacttgaggtcaggagttcgaaaccagcctggccaacatggtgaaaccatgtctctactaaaaatacaaaaaaaaatagctgggcgtggtggcacgagcctatagtcccaactactcaggaggctgaggcaggagaatcacttgagccagggaggcagaggttgcagtgagccgagatcgcgccactgcactccagcccaggcgacagtgttagactccatctc

SEQ ID NO: 412540 - DNA, 495 bp, Homo sapiens
cagattagccagacgaggtggtgggcatctgtaatcccagctactcgggaggctgaggcaggagaattgcttgaatccgggaggcagaggttgcagtgagctgagattgtgccattgcactctatcctgggcgacagagcaagactccgtctcaaaaaaaaaaaaaagccctccaaagagcctcctcttcatctgaccctcccagccactgtctgctggctggccactgtcaggattcgtgcttaccacaccctactcctgtctgccaaccctgtgaaacccagaagcactggcacctctgagcggcccacgcctcaccaggcgcagctctgctccagtcccaccagcagcttgttaagtaggccagaatcaatccacctcatcttaatgtgccttttacttagtgtttcaagggctaatgaattaaaatacagaaagcccctggagtttttaaaagtatgggcttgattggtattaatgggcttattaaaacct

SEQ ID NO: 412541 - DNA, 356 bp, Homo sapiens
agaacaaacctgtgcctgggcactagatcacttgctgtgctgaacaccactcctgccaatgccctttgctctgtgaggatgtaaaatcaggtgtgtgtgggctgctgttttgggtttccagcaggctcagagctgttctcagactcaagagggacccaatcgccatcaaaacccacatgtccagaagtcagtggctgaaaccacaaagtagctccagtcgctttaagacaagatggattaggccaggcatggtggctcgcgcctgtaatcccagcactttggaaggctgaggcaaatgggtcacctgaggtcaggagttcgagaccagccaggtcaacatggtgagccccgtctct

SEQ ID NO: 412542 - DNA, 431 bp, Homo sapiens
cgcagggattggctgcagcacccaggtaggtgagctccattattctgggtgccaccttctagagaactctggaaggctaaacaagctcatctcctgcctttctctacagctacgcggaaagacttgcctaaataatgaattactaacgaccgaaagcctttgtattactttaaggggaaaaagtcacaatttgtgactggagttagattaccaatgtgaaatggccatttgcggcttttattccgaaaatggaagtgattcaacctcctccaatccatgttttcttccatttatttaggcatctcagccaaaaaaggtttggctgatccccttaattactgagataattgccttaattctttcttcactttactaatgtagctccagctttgaatcttaagctttatccattaaatccttgtaattgagaa

SEQ ID NO: 412543 - DNA, 333 bp, Homo sapiens
caacaggcctgggtcattctgttaggcatgtatgtcttttattcatgttttctttttttggctgataatgatggcttgtctttcttaatttatttttttaaatattattactgaaatctaatatatacagaataaagtacaaaaagtgtacaatttgatgaatttttattatgtgtctcacatggaatcaccactcaaaaggctccctcaggccaccttcccagtcagccgccactcccacctttacattggaaccagtattttgacttataacaacatagattatttttgccccttattgaatttcataataaatagaattatagaatatgt

SEQ ID NO: 412544 - DNA, 477 bp, Homo sapiens
acacttgttagcaagcagagctatgagatcatatcattgagaattttagagaatatgataaaaattgatcttgtattggccatcacatgagagcttgttggaaaagaatcatgggtctcaagatcaaatgaattggaatttgcattttaacaagatttccgggtgattcttgtgcacatgaaagtgtgaaaaactctggtataaagtagagccctttcagacaacaggaggcaggatataatgatttatctcttcctctttccttttcttccttcttattggcctgttatctcttcaaccagccattcatccatccatccattcattcattttctatccccccattcatccatttattcatcttttaaaatcacttttaaaatgtaatagatcccctgagaggtatctgagaagaaaatatattctgattaaattatgcatcaggattcttatagggaagtaagataaatgtacaaa

SEQ ID NO: 412545 - DNA, 437 bp, Homo sapiens
atctgtatttacagccgctccccatagctccccattactgcctgagctccgcctcctgtcagatcagcggcagcattagactgtgcatgtgagggatctaggttgtgtgcaccttatgaaaatctaatgcctgatgatctgtcactgtctcccatcacccccagatgggaccatctagttgcaggaaaacaagctcaaggctcccactgattctacattatggtgatttgcataattaattcattatatatcacaatgtaataataatagaataaggtgcacaataactgtaatgtgcttgaatcatcctgaaactatccctccacgcccgggtcatgggaaaattgtcttacatgaaagtggtccctggtgccaaaaaggttggcaaccactactctacactaactgctcattttcctgggagcctaaaacttctc

SEQ ID NO: 412546 - DNA, 777 bp, Homo sapiens
gaaaattaaatggaagagtgtgctgtagagatagcactgtgatccagggcttgatctttgaaggcagactgcctgaatgacagtttccttttctgtaaatgagagtgaaattatctacccatgcatggaaaaaaaccctcaacaaactagaaacaggagggaacttcatcagcatgatgaaaagcatctgtgaaaacctaacagttaacagatttaatggtgcaagactgaatgctttcccctaagattgggaacaagacaaggatggccatgttcagcaggtctatgcagccttggttctgaccaggatgattaggcgattgatatataaaaggatccagattagaaaggaaaaagtaaaactgtcttactcccaaatgtcatgatcttgtatacagaaaatcctaaggtatccagtttaaaaaaaaaacaaaactagaactagttcagcaagttcacaaaatcagcatacaaaaatcaattgtatttctgtacactagcaatgagaaatccaaaaatgaaattcagaaaattattccattcacaatagcatcccaaagaataaagtactcactgtggaaagaaactaaaaaagaactaaataaatgaaagatattccatgttcatggatcagaagactaaatattattgtcagtactcatcaaattagtctacaggatcaacctgattcctatcaaaatcccagctaccttttctgcagaaattgacaaggtgatcctaaaattcatatggatatgcaaaggacacagaataagc

SEQ ID NO: 412547 - DNA, 735 bp, Homo sapiens
gtgagaatgtggaaaagactaccctttatgctcttgccttttcccccatcagcttgttcttaaaacatatttggtcttcttgatagtaaaatacaagctgccatcactttcataaagagattgttgaataaattctaggcatgctttgctgtcttacacaggagttggcagattttttccataaaggtcaatattagatattttttaggctttggaggccatatgatctctgtcatgactatttagttctgccattatagtgcaaaagcagccaaagaaaatatgtaaatgaaagagtgtggctatattacagtaaaattttatttccagtggcaggtagcaggctgaatttggtctgtggccatagtttgttgacccttattatatcaaaggtttgaattatctggatatctatactacaaaatgaagttagaatttcttttagagtttttctgcttctccaaattggtggttttttttttttttggccaaagattacattataaatgcaaaagactggtctaacattaatatatattattggtgccatccaaggtaattaattcatttcaacttggagatcaagttatattctggagattcctcaatttggattgtttttgatcaataaatttaatggcaataaaatttcatgctctcacaacctcagaatcatcgtccattaaaaaaaattgaaattattatctaggcggtcacctctttcttgctgttttt

SEQ ID NO: 412548 - DNA, 352 bp, Homo sapiens
aaaaaaaaaaagttgcccataatctaaaatgagtatgttagattctgataagagttgtaagtcagcccggcgcagtggctcacgcctgtaatcccagcactttgggaggctgaggcgagtggatcacgaggtcaggagtttgagaccagcctggccaatatggtgaaaccccatctctactaaaaaatacaaaaattagccgagcatggtggtgcgcgcctgtagtcccagctacccaggaggctgaggcaggagaatcgcttgaacctgggaggtagaggttgcagtgagctgagatcatgccactgcactccagcctcggtgacagagtaagactccatctcaaaaaaga

SEQ ID NO: 412549 - DNA, 384 bp, Homo sapiens
aaacatcaatctgtgtatttttgccctgcacttggcttctgcagggttatcctgctgctgtagattttttgccaacatcaggtcacaacttctgtatggccagtttgtgagtcaccctgaacctggtgacagtgaggtcaagatttggaccaggtagctttgctctacttcttggccacaggctaccttctgagtgcagctgcctgtctcagagttgggtgctgtagccgcagggccgactagatagcacctgtggccccatcacagccaggagcaagggcacgcccaacttggtgatggcccagaatggtcagttttgatttagcgcaccacaaacttatttattgtttattctcattcttaatctaatcttgtgttttctca

SEQ ID NO: 412550 - DNA, 484 bp, Homo sapiens
ggagaactcttctaccaagtctggatggcagcagggcagagtttctggtgcacctggccccatacagagtataggactttctggaaggtcattctatgactggtctcttgagtagatcgtgatatttcaaagctgccgatcttgcttttacaatttacaaattacattaaactttgcatccttaccagtttgctgcagtttgttcctcaaccctacaatgtagacaggaacacatttttggctaaaagtattatcgacctctaaattaaaatttgttatttaagttgaagacctgtttgcattgtgatttccgtatgaatcatctttgctcctaatgctaaaaccaatttatactttatccccaaactgttgtgcttgtatagccatacttcatgggtgatggtctgtcagtgaatttgttctctttaaatggcttgcaacatattatcaaggtaaatgcaataaaattgctgggctagtgttt

SEQ ID NO: 412551 - DNA, 352 bp, Homo sapiens
tactctattcacatactaactctgtgggcttgcataatcacgcattgcatctaacatacagtcactgtgctaagtagttactgaggctacaggtgtggtagaagatggctttgctccaattatatgggagagcagattccagtttccagatctagtttaaatgaagctaaaacaggaatgaactttaaaattgctcccatcaattcagtctgcagaaaacactgatgctgatgaagaaaatggtggctcacacctgtaaccccagcactttgggaggctgaagcaggcggatcacttgaggtcagcagctcaagaccagcctggtgaacatggtgaaacaccatctcttcta

SEQ ID NO: 412552 - DNA, 444 bp, Homo sapiens
cttctcaaacttatgtgggagaaggcaatcagggaggggccggacagcctcgtcctcacttgcatggttgcacggaattacgaagagctgagtgcactcctcctgctgccctgggctgccatgaccaagtcctgtattccttatatggatgccagtagtgtgctcctcaaaggtctgtgctccgtggtattgcgccagctcagcgttggctgttctctagggaaaaaattgtgaaacttcataaacctgagttaggattagagactacagatgccaagtcatagttcatggttgagtgccgacagtaaacacccaagaaagcgtgtatcaggatgaaggacatcttactgattcgaatttccagtgtcagaaaggtgaagttttccctcccaacccctcatactcgttaaagagtaaccccccatcccttgaaaagaaatgaac

SEQ ID NO: 412553 - DNA, 374 bp, Homo sapiens
ctgggcgacagagtgagaccctgattcaaaaaaagaaaaaagtaaaggtctaaataaagtgactttttcctactctgattctttaggaaaaaaaaaaattgagcctgggagtggtggctcacactgtaatcccagcatctcaggaggccaacgcaggaggatcactagtggccaggagtttgagactagcctgggcaacacagggaaaccttgtctctacaagaggaaaaaaaaaaaaaagccaggtgtggcacatgcctgtaagcctagctacttggaattggaaatcgcctgaacccaggaggcggaggttgcagggagggagactgcaccactgcacttcagcctgggtgacagagggagactctgtctta

SEQ ID NO: 412554 - DNA, 230 bp, Homo sapiens
tgactatgcccatttcccagcaaacatgtcttagtttccatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaagacaatggatg

SEQ ID NO: 412555 - DNA, 190 bp, Homo sapiens
acttaacagtgatgttttatctgttgtgctttctatataatgttttagaaattagttttatgtgcatgttttcctgggaaaattcttgctttcacttttaatattgtcagagtacatattattttgccgctgtcaattaatatgcaaatatttttaaatagtattaataaaaaattgttttctaagatta

SEQ ID NO: 412556 - DNA, 430 bp, Homo sapiens
taccactacacaaatttcattgtcattttagttaactcttgggttacagagctttatataaatttctttgtgttatataaatttctataatgtaaatatttgttataaatgctgaagaatgctgttttgtttggagatctgtttaacctgagttaggggatcatttaggcatgtataattccagaacatacttaacctcttttgcaataatctgatctccagtgagttctactccagaacctcaattatggagatactgactttgtttttatcaacccaaaccagctattatattgcatatttaaatttcttgaatataaactacattggaaagttggacaggtacaattaggatcatcctgacagacaaaattgcctaacagggacactcagtgaagagacaccgccccttctctccccacagcaaaaa

SEQ ID NO: 412557 - DNA, 218 bp, Homo sapiens
tagataatgttatgtatagacctgagaaatccttggaaatcattattgttataaatgagaggttttttttaaggttatctttttggattaccttgcatcttaactaaaaaaagtctttttagggaataaacatcattatgacttaagacattgatgaagttttttttcataatctccaacatcatgtttaaatttaaataaaaatgaagcgaatcagt

SEQ ID NO: 412558 - DNA, 334 bp, Homo sapiens
caggctgctgcagcgccacccgcccgccgcggaccctccgcgccctccgcctagtcaccgggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccgtcacttttatgaattcgactccactttctaaaggaattatgagtcttgtggcaaacacaaaccggagtggccgggagggggaaaaggggggaaaagaaaatctttaaaaatta

SEQ ID NO: 412559 - DNA, 395 bp, Homo sapiens
gtctcaaactcctgggctcaagtgatccacccgcctctacctcccaaagtgctgggattataggcatgagccactgctcctgaccaaagctttttttttaacattgtaaaatttaacttttacagaaggaagcgctaataagtcagttagcacttaacatttcgtcagtggcttgtcattatcccaaactttctactactttctacgttaatgtacattgtacattaggattttacagtctgcgtagttggtctcaaggacttcagttatcactagttatcagttttataagctagtagttctcaactagaggctgcccccacttccctgtcctccacccctgaaacagttggcagtgttgctggcatttagtgggtagaggccaggaatgctgc

SEQ ID NO: 412560 - DNA, 343 bp, Homo sapiens
tcatccattaaaaagaatgaaatcatgtcttttgcaacaacatggatggaactggaggtcattgtcctgagtgaaataactcagaaacagaaactcaagtactatatgctctcacttataaatgggagactaaaaatgggtatacatggacatacagagtgaaagaatagacattggagacatcaaaagttgccagtgggttgagggttgaaaaattacctgtggggtacaatattcatactcaggagatagttacatcaaaaatcaggacctcaccactgtacaatatatccctgtaacaaaactgcactcatattctgtaaatctgtaaacaacaacagca

SEQ ID NO: 412561 - DNA, 282 bp, Homo sapiens
cagtaatatggtatgtaacttaattttctgtctagatagcaattaatgatgcttattaattggttctgtactaatggtactgtgctaacgctgtttatttttaattaaaaaagtttatgtaaaaaaattaaacaaattaaagtggggagattgttctctaaagtttgtttctaagatgtatcacctcctgtgcattcccattaactatgattagaaatcacatctatatagagttaaaagtatgttgctatgtctgtcaataaagcacagattttcatgttg

SEQ ID NO: 412562 - DNA, 389 bp, Homo sapiens
tctttttccttttacagtcttgtcttttttaggctagagaagaatcttaacacttgcaactcttatttagatgtagcttcctctgccttgaattgcttcggtgaagcagcatgatgcatagtggacatggcttgcaacttgaagttaatggctctgtcatttactaagggtgtgtacttaagcgagccattgaaacttctttggtctcgctttgtcatgtataaaatgagaatgataatgataccagcctcaggaaaataggatgagagcaaatatatgtgcaaatctattttagacctgtaaagtcatgtataagtgctaccttttggttttcccaagctcgttgcagtttttccaagctgtgaaaataaaaaggacttaatgatgca

SEQ ID NO: 412563 - DNA, 2003 bp, Homo sapiens
  misc_feature (1)..(2): n is a, c, g, or t
  misc_feature (671)..(671): n is a, c, g, or t
  misc_feature (1052)..(1052): n is a, c, g, or t
  misc_feature (1124)..(1124): n is a, c, g, or t
  misc_feature (1725)..(1725): n is a, c, g, or t
  misc_feature (1779)..(1779): n is a, c, g, or t
  misc_feature (1842)..(1842): n is a, c, g, or t
  misc_feature (1877)..(1877): n is a, c, g, or t
  misc_feature (2002)..(2002): n is a, c, g, or t
nngggaagccgagggaactgctgccttctaagagttaaagacaagtgaaatgaagttcaggattacttattttcttcacaagaaccccatgtcatgggacttcttttcttctccaggctacttcagcaagcctgttctctttggaaatctccagaggagacagaggtgtcagtgtctatggaaatgtacaactcacacgtttgggaatctgacatgcccttccaagaactccctcttctactccgttctactccactatgaggtcagttccaggaaagctgccagcaatcatttggttggagaagaagatgcaatctcctattcttgcaggtctctaaagcccagacactaaaattttccctttggaggctgctacttcacttggcctctaaccatgattgctgcattctgtagtaagctaataatttcttccatcattcatgtctcagttccctttctcatcctttcttgaatgttattgatggagtgagggaggagacagcagtagttgattgaagtaaggacaactgtgctctttcctagtaaggctccagtggaggtacctagaatccaagtgctcacagtcaactgctttctttagaatgtggggtacatagaatgtattgccctcaaatgtaggtctttgctaattgctggacagcaggaaaatntccacacaacctcctcttagatttgttttgtttatttgattttgtgactaccagagttgacatcaagaactggacaagagttcaaaattctcttgctaccttcattgtctcttgaatattttatggcttaccattggacacttactgggtcttaatgcttcatgtgtttgttttgatatgtcttctggccatgagcattaattggatggtcctccatgattttttctttgctaataggtctctgttcattcttggctttatttctaaagattctctggtggttctgggtaccattggtatgtatcaagatatttatagccactgactacttgctttagggatggatattgttgtcagtttctttcccttttttggtccagntttataaagtttgtgatgcacaattggaataataggtagagggaaagaactagtgaagcaggataatagaanaatagaaagaaagctacaggaaatttatcaggaatggggctttttggagacattttggacttcaaattgtgaaagtcccaaggacatctgtgtggtacaacagacttggggagaagaaaaggaggtttggtgagacagtgctgtgggttatgagtgtattcacaatgatggtttctatgtggtgaagataaacgtagtgcttttacaattactttttgatgctgatcttcaattcttgaaacttaagtttgtcctaggctacgctatgtgactttctgattttattctggttctacaaagaaaacatagcctgataatttcaaaatatccaatatttccttaaattaaaataggagagacctggaatcaatgaccttgtgtttagtagagcaactgaatgaggttttaaatctgcagatatagattatgataggctttccccaccccatgccctcccccacaagagggcagtgagcaaaagataaattattttgcataagaaagtaaaagaaatagggaggcagaagcaaatagtaagaaaagggggcaagggtttagagagccaaagagaagaggacaatgagcaaggaaggaaggcagncaaaacagaaagaaatgtctctacccttagagtataactgatgaaattttagcncaatgttgtataatattatattttaagatagtatcttacttgctgtactctaattctctttgntattccaaatccttggaaaatttgtttactgatancagtactttgtaaatagtactttggaggaattaaggtacagaggcacatggggaatgctgcaaaggaaggagacggaagacgcagaagacagggagcagagagaacactgataagtcagtgaaanc

SEQ ID NO: 412564 - DNA, 452 bp, Homo sapiens
cactttgggaggccgagttgggaggattgcttgaccccaggagttcaagaccagcctgggcaacatagggagaactggtctttaaaagagaaagtaaaaaggaggggaaaaaatgagtaggacatggtgaaggaccacaagtctaatagtactatttgttttattggggccaccccatgccctgggttggttgtccacactgtggtcacagccttaaacagttctggaatcatagcagtctctccattggttggctacttgtcttccctctttatgttggtttttttttttttttttaagccgtggagggttgggagagaaataggcattttatttgatgctgattccctgtagctgcctcttcctttccttgtgatttttgccaggcaggtgactggcctttcgtttgtgtggttcatctgcagtgccctacccgcttcctttgctcttgc

SEQ ID NO: 412565 - DNA, 410 bp, Homo sapiens
ttgtgatttcatttagtgagatctgggagcgtgctctgaagtcacctgtcctgagcccctcagccagcagggcttagtcgggccccgtccaggccattgtcacttttgaggaagactctccaagatttataaacaggtggtgggtgacctgcccattgtagtccataacctgttgctgccagcagctcctgggaaggggcgataggagagcactgcctccttgtcccgtgtcccaaccgatgctagagccagtgcttcaggtattcaggtacctcaggttgcttggaaaagtttaaataaattatgcttacttattaagtattctcttttcatcttttatcagctttttttattggctcccctgcagaaaaaaaaaagtcgacgcggccgcgaatttagtagtagtaggc

SEQ ID NO: 412566 - DNA, 433 bp, Homo sapiens
atctattttattttaaacacgattggaaaccattgaagaatctcaatttggggagaaggatggggaaactgaaaggatatgatgatttgagattttgataatttttcacagtttctttacagagaagattggacaggcagaaggaaacagtgaacggagggaggctagttaggtagctattttgataatcagggcaaaagatcgttgtgtttttcacaggggggtagcagtggcaatggaaagaggtgtgtgaggattcaggatatgctacaaaggtagattggattggacttgctctactaaatggcaggagagagtgaggaaaggagacatttcaaactgaaaattgaatgacgatggataatggtgtcatttaccaagggggggcaggtttctagggcgagaaagaaaatcactatcggtaggtctgaat

SEQ ID NO: 412567 - DNA, 594 bp, Homo sapiens
ggatgtcatgtccagatcctgtggggaatttgaagagagcaaagctcagctgctgtccaacaggggcttgggatctgggtggagaagcaaaatagacacataagtcactgtggtagaacacagcttatgagcgtaagatgcagttgtgtgagtttgcagggccaggggagggcatcactcaggtaggtttggacaactacttggagatgggattcaaactgggcctgaccttggaagaaaattaaaaataacagtggttgtcaatttcaagtgtctgcatgggaaaagtgggtttgggtttgtgagttccttttctttgcccatggtcctttatcttttcttgtgggaaaacctgcttttctgagacaatttgtcctgtactctcttctcctttccctccctttctcatattttctctacctttttgttttttccccttatttttcatgtggagggatccacttttgtttggcaagtcgagtattcctttctggggctggtggcccagttcggtaacaatttggtgttgtttccaacttgcagtgatagaaattctacagtccagccaacaaaaatcagatcacaccacttcta

SEQ ID NO: 412568 - DNA, 1498 bp, Homo sapiens
gatttattttctctctaagttgcatgagtaaaatgagtcttgtgattttgtaaaacgtagctgtgaaagagacctgaaaatttgagacttgctgggaagagttctttatgcactcaggtgtggaggacaggtgcaggggaaatttgttgtgtgatgctccagtacccattcctgtcttctccctttctccctctaactatatcttgaacatctctcttttctatatgatttgggtgtggagttgatctgtcacaaagttcaaggattagactgtaatggacctaagccaatttatatcttctttccctagctgcagttattagtttgggtttagtcaaatgtcccatttcaagacaatgaaagggatcccaagacctggctatgtgctgttggaactgacattttcttttccctggagcatttagggttagcatgtgtggcttgaaactggggcagctatttggttgtcataagagtaaagctgaagctactgtgtgtatttggggcatgtctaccacatggaatctgatgatggaacaatccctatggaagggagagctaagagacagaaggaagatgagacatcaagggtatttggtaataatgtctaaactgctgaatcaacgaagttcacttaaagcccactctgactctggatcaattgcttaaggcatttcagctgagttttaaacactttgcataaaaattcctatctgatacaattaatattactaactctctgctctgaatagattgtgtttgcttggtaatttgtctggcttcttccaaagacttagtatacttgacacttgatggccaatgggtgctgcacagaccagtaaatggtgaatctagcttccaacttggacccagctttctgtttgcatgtctagtgtgcatttttgttagggttgagagttgagtaattgctttatttgatagtatttgctgtgttttaatagaaagggaaataattatatatcaatctgctaaatgactttctttcctccttaagatctacctttaacatttttttctagtgattgtggaactcaagcccacatagaagtggtatcttctctgacttttggctgctgaagttttattaggggtgccctggtaggtagggagtcttgattagtctgtatcacttaagataattcctttccctatgtgcttcttggtttagaagcagccaaatttttgtgacctcattttggccaattgacacaaaacatgaattggaagtctgctgggcatgggggtgcttcaggcaagtttcttaactagttagagaacagaagacccgaatgtcattgaattgctttacctcttgccttcttgtgtgagattttaagctagctgtcagagtttttttctttctttcttaatttatgtcaaagaaagcatcctgatgcattttgcaaggaccacatgaagtagggaattgttgatttccccaaggagggatccaagagccaaaataagaaaaaagaaa

SEQ ID NO: 412569 - DNA, 454 bp, Homo sapiens
gaagaatacaaaagtgagacaaacatcattttcttttgttgcatccttagcggctttgagaaagaaaggtcatgaaaattatttttaaagttaagtgctgagcttatcaatatgtttttacactcttctaattactattactcacagatgaccaatgataaacattataccctttttattaataggcgacaacctgtagagctttcagagacattcctgggtttgagcattggctccatagactgaatactacaatatagaacctttaacgagctgttaaagttctgaactttagtttatcagtaaaattagtatggtaatgcatatctcagagttgtcatgactatgaatgatagagtatgaagtcctagaatgttgtggacattcactaaattttttcattttccttctctcctattactaatagcatctactaccatagtagatgaaaaaa

SEQ ID NO: 412570 - DNA, 470 bp, Homo sapiens
tctagagctctgctcgagtgatccttgaatagactcttggaatgcttgtgcttccctgtatgactgctctgtgtgctgctgaaatggaactgaacctcgcccgcccacccagccagcccaggggtttcacttgacagaactcggtttgaattctggttttaccacttactagttgtgtgatttttgagcaagtcactaaaattctctacgcctcagtttccccgtatgtgaaatgggaataaacatggttcctatattgtaaaattgttatgataattacatgaaataatttacctatgaagtgcttggcaagttaagtactaaaaagatgttagttcttttctccttcctttcctgttatacttgggcagccccaaaatcccctgctctcattttagcccctcctgggggctctgtaccatctagtgtcaataataatagagatgaggagaaggagaaatcaatccatg

SEQ ID NO: 412571 - DNA, 418 bp, Homo sapiens
caatcagggtataaatgataattacagcttgtttatgactttaaagaaagattccaaagtaatatctcctcagtagcaatagttctcaggcatcctgagaattataagaccacaaagggattttttttttgagacggaatttcgctgtaaccaagggattttaaatcctgtaatagttgtgctgaagaccagaaaagtccgctttctccccagcctaacactctacctactgtattgcctgaccttcgaggttaccttgaaagggtaatattgtatacacctgtagttttttactactcactgctgtttctctggcagtgttcatttcgaggcttgccttaagaaatccaaacctataattatgtcttaaatgtttgcctttgggaactgcagacattaaaggtctattttgaggcga

SEQ ID NO: 412572 - DNA, 455 bp, Homo sapiens
aagtatatgtatctcttgtatcaaaagtactcgttttaaatgttaatcagatagcattttccatcactgaaaagcagtttggatttgcaaggctcaccggaagttgggttcttttgttttgttgctgtgcctggaattctggcatcagtttaagtagctcaaagatacatggaattcagatatggtgaatcaacgtctcacaaaacagaaaaaaagactccatagttgaatgtactttatccatggaaaatgaattatttggatggtagttccacggatatcttcttgttagaaaattcattgatttgatgcttaatttctacagtttcctgtatgtgttattaggtaacaataacaaaaaattaaatagcttatatctcttagagattaacaacaaaagaagatggcataaattgaaacaaattttaaaataaatgggatcttaaagtactgta

SEQ ID NO: 412573 - DNA, 403 bp, Homo sapiens
ggagtataacgaggtgtctttgtggggtgtgcttgtcatgttcccagatgtgtattatttgacagctaaagaaacaaaagcaacaaaatatggcatgtacgtagagtggaatagtgtgcagccttaaaaagaaagggtattctgacgcatgccacctcctggaggaagcttgaagacattaagtgaaatatgccagtcacaaaaagacatactgtggaattccatgtatatgagggagctagaggagtcaaattcagaggagacagaaagcagaatgggggttgcccggggctggggagtaggggaacagggaagtttttttgtttttttttttttcctatttgtatttttattagaattattgaaggagaggggagaggtgctattgataatattggggctt

SEQ ID NO: 412574 - DNA, 302 bp, Homo sapiens
gtatttttaaactatgtgtatttcccctgcctttatgctttgttgctaacctctaatggctaacatattaaaagttttaaattagaatacaatatgactatagtgactgtattttttaaactaaaaattggaatatgacctgattatagaccattttaaatcagtacttttctaaatagttttgagtaaatgatcacagtcaaaataaagaacaaaggagagttttaatttctgtaatggaatagtacctcctattgaaccaacctttccacggataagaatgatagattctggacaaaata

SEQ ID NO: 412575 - DNA, 176 bp, Homo sapiens
tcaaaaacgaccctattgtataaatcagaaacctaacagtcatcctaaacctgtctccccatcccctctctgcttccttctcgctaatatctccacattcaatggatgttttaaaaatataaactcaagattttattgtcttcataataaaagaaaacatgacacttagaactgga

SEQ ID NO: 412576 - DNA, 354 bp, Homo sapiens
ctatagtgccagctgcttgggaggctgaggcaggagaatcacttgaacccaggaggtggaggtttcagtgagccccgactgccattgcactccaggctgggcaacaagagtgtaactctgtatcaaaaaaataaaaataaaaaaaacacactcaaaaaataaaaagacattttctttagtccatgtctgatccaacaagaaagaggaggaaccaagtcaagaatgagtgaagaagctgggcgcagtaactcacacctgtaatctcagcactttgggaggccaaagtgagaggatcacttaaggccagaagtttgagaccagcttgggcaacatagcgagacctgcatgtctaca

SEQ ID NO: 412577 - DNA, 289 bp, Homo sapiens
tagtgcccatggaacatttgccaaggtaggtctgtatgttagacagtaaaacaattctcaataaatataaagtggttaaaataatacaaagtatgttctctgaccacagtggattgaaagtagaaatcaataacagaaaaaatttgagaaattcacaaatatgtcaaaattaaattacttctaaataaccagtgattccaaagtaataataaaacaatagagaaaaataacaactccagaagttggtactctgaaaaaaactgacaaatatttgtctgcactgaccaag

SEQ ID NO: 412578 - DNA, 478 bp, Homo sapiens
ctcccaaagtgctgggattataggcgtgagccaccacatccagcttgtaaatggtatatttttaaatgtcagtttctaaaatgttttgttagcataaagaaatacaattgactttttaataccaagccatcttgctaatttaataatttagttctagatctgatttagactttatagttgtgcaattgtactatctgtggaaaatgacaatttttctcttcctttataatctttagcttttttttcttttccttggctttttgcaagataatgggatgtccagtgtggtgttatatacaagtggtaattgtaagtgtccctgttctgttctttttgtttgttgttctcaagctcaaagaaaaacaactttgctatttcgtcattgagtatgataacacttaaactttacttactgtaggattattgtacataatctttattgtattaaagatgttcctattttgctaagaattcaaat

SEQ ID NO: 412579 - DNA, 278 bp, Homo sapiens
agctacatattccaggagggaagttagaaaagccctattagcttttccagttatcactctcctattgtcaccatagcgacagatgttatatgaaatcaactgctttattgtgaaaacaatgtcggttgaaaactggccttgaggaagttgtgaagatgagattcaattttgatatactccctgtgggttttcttttctatattacttttttaaaaatatactttattgcagtgtaataatataaaataaagtgaaaagtcaaagggtcatcttttgaa

SEQ ID NO: 412580 - DNA, 180 bp, Homo sapiens
agttttattaacaaaagttccagctacaaatgattaaaataggcttgagggagacagacacccaggtcctccacttagccagatctgagatacacaagactgactggagggagactttgtaacttgaccagaagatgtgaagaacaatttcaagacacgtctatttaggcttttttcatg

SEQ ID NO: 412581 - DNA, 210 bp, Homo sapiens
catctcctgtctgaagttttagcagctccacctcttctctccatctgctaagagcataagttatagatctcactaatattgctaaaacttcaaaatattcacaaatctaaatccagaagagattagaacatggcatgaaaagtgtgtatttcagaacatggagatggcctagcttaaagacatataataacatatttcatttcatcaaaa

SEQ ID NO: 412582 - DNA, 419 bp, Homo sapiens
caattttttggttgtttatttggttggctttttggaaggcaaatttgaaaaggggacctacacagaagtgctgacccacccacattcccttattatcatcacagacaagaagaaactagcagagctaagaatggagtgaagaaaggcagtgtgataagcaccagcaaagagttgagggctgttgctctctaaattattatttgattattttaaaagtatggaagttttctagtcactgaaggaaggaggggaaagtgcaattatttttatatggagttacttaactacctcctaaacacatacgtggcaattgtttttgctggtgcaaagtattttaattagcaagaattcatatattgagattataattagagaactcaatttatatatttgctatcctgctcaagcctgacatggca

SEQ ID NO: 412583 - DNA, 350 bp, Homo sapiens
gggacataaaactgaattggccccaaaattatttcttcctttggcttctatctctactccactgtcaccacctccaaggtaacccagaaaaaaagtgtaaaggaaaagagaaagttcaatgatagatgagtccaaaattattttattgaaaggtctaaattccttacaggtaaaaattctactctttcctgaaatactataattttctgtgaagatagtctcaaagttttctgtaaaataccacttaatatcacttaactagtgtcagcagtcactattttgggttgatcttttctaaggttgtgatgaatttcactgtagaacttcatagcaaatatagtttataggac

SEQ ID NO: 412584 - DNA, 427 bp, Homo sapiens
ctttaagtaaaaatatgctgttttaatatttaatttagtagaattaacaaaaactttttaatagtcaaactgaattaccttgttttataaatgttaaattgtttatatttaagtaattagcttaaaaatatagttttatgttttgtacattaattgattaataaaataataattttatgtgagaatgttttcaaaaagccaaataaagtcacagatattttagcttctttcccagaataaacttatcatgcatttgcttacctaaaatttaagtttcaaattagttctctatatgagatacttaatcgagcatatatatttatattcattgatcaaactgatatgctacaggagaatgtatgcaatgtgtaaaaaatgcaaatggctgtatgcattgaataaaaataatatacaattagagtaagaa

SEQ ID NO: 412585 - DNA, 391 bp, Homo sapiens
caatctagaaatgtactataagatatagcgaacatccttttacatctatagctgagtagctgagtttgcaaaaaagagaaatcccagctgataagaaatgcaaggacaggctgggctcggtggctcatgcctgcaatcccagcactttgggaggcctaggtgggtggaaacctgaggttaagagtttgagaccagcctggccaacatggtgaaaccccgtctctactgaatatacaaaaaaattagccgggcatggtgaagggcaactgtaatgccagctactcgggaggctgaggcaggagaatcgcttgaacctgggagacagaggtagcagtgaagtgagatcgtgccattgcactccagcctgggcaacaagagcaaaactccgtca

SEQ ID NO: 412586 - DNA, 428 bp, Homo sapiens
cagtggacttggtaaagaaaacatgatacgtatgcatgatggaatactacatagccataaaaaggaacaaggtcatgtactttgcagcaacatggatggagatggcagacattataaaaaggtaattaatgcaggaacagaataccaaataatgcatattcttttataagtgacagctaaacattggagtacacatgtacacaaagaggggaatagacaccagggcctacttgagggtggatggtgggaagagggtgaagatcgaaaaactgcttattgagtactatgtttattacctgagtgatgaaataatctgtacaccaaaccttcatgacatgcaattaacccatatatgaaacctgcacaagtactagctccacataaaataaaaggtggaaagaaaaaaatgaaaacgctgcccctccagt

SEQ ID NO: 412587 - DNA, 472 bp, Homo sapiens
ggcctcccaaagtgctaggattacagatgtaagccaccgcgcccggccacatttttttttaaggctaaggaagaacgggaagtgggtggctgaaaaaaatcaattaaaaatatttatttgctagttattcattttgtccttgatatgtatttaatttaaagcaatttatttttcttttctttcttccctgaagcaaatgtaatttgaacacagactaattttttttatagctaaagtgaaatgttaaacaaaatcgtcatcccttttagcactacctttaagttattctttacggaagaactgggtaaacccttcacagaatgtttgcaaaacacctgatgcacaatatggtgtaaactgtcacatttctctttaattttttaatagtgaccaaagtgaatatttttccagtgattgctccataatattatgctacaaatgtgttgtaaataaaagattgataataaaatac

SEQ ID NO: 412588 - DNA, 455 bp, Homo sapiens
ggatccagagtcagcacgtggttttggattgctcaaactcactttattctcatttcgcaagccctgtgtcttaatccaaacacggtaaggtagagattaatgagagaatcttgagaggcaggtgttatctgtgtgtaaagtcctctattattttggggaggcataatgatggaaagttccagattttatatttctaaagaaatatttcaccgaaattagtaggctacaatagaaatgctgatttttcaattctaccatgtacagccagtaaaaacaataacacaccactatctcctgtcaccatcatttcatttaacaaaaggatatttccattcaaacaatttgaaagaacagaatctctcagaataaaatatttttaaatggaatcatttagctatatggaaaagtttactttcagaccagcctgtgtgacagaacgagactctgtctttaaa

SEQ ID NO: 412589 - DNA, 526 bp, Homo sapiens
tgtacgcacctgtaatcccagctgctcaggtggctgaggcaagagaatcacttgaacccaggaagcagaggttgcagtgagccacgatgacaccactgctctccagcctgggggacagagagagagactttatctaaattccaaaactttgggaggccaagggcagatcacctgaggtcaggagtttgagaccagcctatccaacatggtgaaactccatctctactaaaaacacaaaaattagccaggcatgctgccgcgtgcctgcaatcccagctactcgggaagctgagacagaagaatcctttgaaactagtaggcggagattgcagtgagctgacaccatgccactgcactccagcctgggtgacagagcaagactccatctcaaaaaaaagaaaaaaaaagatccgaatggcaaacagtgacctagaaaacagtaagacaaatacggaaaacagaagaaactaaaagaagttgattctaggaaaacaaactgatcagatttgctagactggacaagcca

SEQ ID NO: 412590 - DNA, 535 bp, Homo sapiens
tcccttatttgttgcaggtgactggcctccagcataacaagatgcacctggtcgtgtgtgcccagactgctggcatccagcctcgtgggtagcctcattagttcttctctgcgtcctgctttctccaggaaccacggggccctccagacctctcggcacgatcgggattccacagagccccggtgccgccgtcgggggcacttgtcccactgttgccagtggaggatgcacttggagtgccttttcccaccgtaccagagcgtgcatgtccgtgtgtgagcctgtgtgtccaagagcgtgtgtccgtgcatgagcctgtgtacctgagagcacgtatgcctgtgtgcatgagagcttgtgtgtccctgaaaaagcatatgtgtctgtgtgcgtgtgagcctgtgtgtacctcagtgtgtgcccgtgtgtgtgagcctgtgtccgagagagcgcgtgcccgtgtgtgtgagcttgtgtccctgagagtgtgtgtgcccatgtgcgagcttgtgtgtccgagagagcgtgagcccgt

SEQ ID NO: 412591 - DNA, 385 bp, Homo sapiens
tttttaatcaaacattacggaagggtttaaagtgaagtcttcttctcccttcttatccccaattccattcactagagataagcattgcttagcagtttgtgtatatcctttcacaacttttttcaggatttatgtaagcatatacacagacccacagtttcttgggttttgttttttaaaattacaaaataaaatcttactagaagtattttacagcttgcttacttaacccagtgtgttggggatattctatatcactcaatacagatctattacgttcttcatttgatcttagccatctattgcattctttcttttttacttatttatttatttatttatttatttatttatttatttttgagacagagtctcactctcttgc

SEQ ID NO: 412592 - DNA, 324 bp, Homo sapiens
attcttgagataaaagtcatcatcatgatagatagtgtgcctttgacatcagaccctagtgtccaggggccattggcagcaaggggagggtgtttgtcatcagtctggaatgctttgcggggaagggtgggaaaagggtccaagataatgggtgaaaagagagttattcaaagttattcaaagctttctgggagtttcaggataatagaaaatgaagagaagagaagattttatgtgatttacccttcatgtgttcttgtttttaccttttccgtttttttgttttttgttttttgttttgttttgttttgtttttgagacgca

SEQ ID NO: 412593 - DNA, 493 bp, Homo sapiens
ctgcctcagcctcccaaagtgctggggattacaggcatgagccaccgcgcctggcctttttatttacttatatatttatttatttatttatttattttgagacggagttttgccccaggctggagtgcgatggcacaatctcggctcactgcaacctctgcctcccgtattcaagcgattctcctgcttcagcctcccgcgtagctgggattacaggcatgcgccaccatgcccagctaattttgtatttttagtagagacagggtttcttccatgttggtcaggctggtctcgaactcccaacctcaggtgacccgcccgcctcggcctcccaaagtgctgggattacaggcatagccactgctcctggccccttttggcttttattcagagtgagatgggaacccttggagggttttgagtagatacagtgggactcctctttgaacagggcccactctagctgcacatggacaacatattgtgggggatg

SEQ ID NO: 412594 - DNA, 861 bp, Homo sapiens
tgattgaagatgttagatatctttttttctgatttctccatctgatcaataggaatggactttagcttatccattttcattaataccagactggatgagattatacgtgaataacttctacttctgtcttcactagattcaggctgaaaagcaaaagtctttataacacatttctagtcacgtaaataatacaaactttttctaacttttctcttatttgggacacctagctttgaggagcagatggttttcccagtaaactcttagattctataggtatcacatttcagggtcaagaattacgcatatcctcagtataaactctgtaaagactttttttctcttgtttgatggaactcaaaaatggagcaataatagttatcaacaagcaatgagtctgagtcctcaggctttaatggcaaccaacaaacccatgctccttattgcagaggaagagtgcattgttgattcgctttatatccccaaatagaaaacacgttaagggtaatcctgggaaattatgcttacttcaaaccttgattgccaacactgaagtgtctaaatagcacttcaccatttttctggttgttttcttagaaacagttcacttgcttccttcctgtgataaatgccatatttattttagtatgagtcaacctacactttttttatattgcctctctccccagacccccaaatctccaatttctcacaagtgaatttaggcaaactaaagaagacatctctgttccgtgagtattaaaatcaaacatttttaaatgtaagttataaaaataacactttcattgttttcttcctaattactaaagtagtccatgtttattacccctattccacctc

SEQ ID NO: 412595 - DNA, 483 bp, Homo sapiens
caggtaaaatattgacacttataaattttgttctttgacagaacaatatatggtactatatagatctactttattaagtagactaattataactcagttctcctatgtgccttatgatataacttggaagtaagtttgtgaaaaatcaggatatatgtgttgtttgttaaattaactgttttaagcccttttaacacctcactagttttgtactgttttacctcttatttctgaaactctttttatggtgtatcctgttagaggggacaaacatgtcatagaaagcagttgtgcactctttcaaatatagttgataaattcaataatcttatatattgagcttcgtgtttatagtacagtaagtggtctagcaaaattgtccatgtttctttgtttattgataaatgcattgtatagaaactatttcccctaaatatttatggaccaaacaattgtgatatatcctattaaatttgtgtgaat

SEQ ID NO: 412596 - DNA, 303 bp, Homo sapiens
ggaggctgccggtaccttagtgccctctggaacgctgagcggcttggccccggatcttgctcctgctccagatgagatggggaggccctgggagggaggtcttgcttggaaaggatggacgtaaggggctggttcccaaaagagagcaggagctctttctgccagaccagctgtacttcattaatgagtcaagccagaggtctaaccaatccgttggtactgggactttcgtttttctcccctggtttattttattgctattctgagaggtaaacatacacatacacctcaacaactccaagg

SEQ ID NO: 412597 - DNA, 295 bp, Homo sapiens
tgttgttggtgctgttgtaaatcagtatagttagttaggtgtttggatcatcttttaggaaaacttccaggaaagatgccttcaggatctgggttgttacttctgggaccagcactggcagcttctgcttctgaataggaatggaaaagagaacaggtgatcaatgtggaggccagggacaagtcagtgaacataaataacaaaggaggaaagaagaaggaatgtaaactgtcaagggggcattatttcttttttttttttttttggtcccctttctcttttttgttaaagaaaa

SEQ ID NO: 412598 - DNA, 454 bp, Homo sapiens
tttcttctcccctttcctcactcctttcatactagcctccctgctggtcttccagcaggacaggcttgattctttaccagaatgtttgcattttttccttcttctgcctgcaagactgggtccccagatatctggaaagccaattccgtcaccttttctctccatgttttgtaagtctcttttcaaataccgttctttagaaaggccttccccgagcaacccataggcaatgtataaaatgcttcctccccaccaacatcatcctttatttttactgttttgtttttctaaatagcaggtatcacctgtcattacaacgatgtactgtgtgtgtatacacactcataatctgtttattgcttgtccacctcactaggataagcagggacttagtttggttcgttgctttgtgcaatgcaagaatggtgtctggcaataaataagtaaataaaca

SEQ ID NO: 412599 - DNA, 421 bp, Homo sapiens
tctgtctcaaaaaaaaaaaaaagatctcttccagaaaactgaagttgaaggaacactccccaactcaaacttattttggtatctcttttctgtactgattgctggctcacaccccaacttcttggaatctggagataatgctggataattggcatcggtaggtcccacgccccttcagagaactgcaggacacatggaagtgactcaggaaatacttggtgaccattacagacagaatccttgaagatggattctccgttcaaagaccacctcctccaagaacccctcctagtcattctctcaagtgcctggacggagatgtgctgtgagtgtgaactacacacggaatttctttgtttttttgatacgcataattttattacaaaatgttaaaaaatgcagcatcttaaaaaacgcaaga

SEQ ID NO: 412600 - DNA, 447 bp, Homo sapiens
acttgttaggagaacgtactctcaaattacattgcagtttatttacatattaggtttgattatgctttgctaggtagggaggcaactttaggccagatttaatttaataacagtttcctcctttgggtcagcctctcagttttacgagattgaccagaaccttgttttgtctcagtatggaagtcacaatgtcaaattagttgagtgattatactttcttcatgttgttattctaactgtaataacaccatttggtgtacaaaggatggctgcatagagacattgaagactctcgaggggacaacaacacatcagggagactattatggccacgagaaggagtatagcaataaactgaggtacacaccttaacaggagtctccacaaactgaactgatcaaaattaaacaattcaaagttcaggcaataaagatagttcaaagtatt

SEQ ID NO: 412601 - DNA, 579 bp, Homo sapiens
gcccccagcaactccaatttaatgttctctgaagatcaagtccaatggaaaagaagattcttttcctacagagtcagggaaatccacaatatcatgcttacttgtgacatcaactgcgaagttttggggtccctaagatcactctcattttttataattcaccaaaatggctcgcagatctcactgaaagcttacacttgcagttatggtttcttagggtgaaagaatacatattaaaatgagtcaatagaagatactcatggaacagagttcaggaaagttcccaaaacaaagttcccagttgtcctctcccagtgtaatcatggacagggctaacttttctgagtaacagtgtgtgacagtacacacagagcactgccaaccgtggtatctttcctgagtcttcaagtccagaattttaactgggggctcagtcacaaagacataattgactacccttgtggctgaccattagtctctagtccctctagaggtcaagctaatactacatggtccaaagcccccatcataaatcatattattcgactgcacagtttggcccaaagcccctaggttaaa

SEQ ID NO: 412602 - DNA, 419 bp, Homo sapiens
tcctgtcttagtttgggctgctataaccaattgcagcagactgggtggtttataaaaaacaaatttctcagtctggaagctggaagtctaagattagggtgccagcatggttgggtaatggtggggccttcttccaggttgtagaatgtcctcacacagtggaaggggcaagggagctcccctggatctcttattaggtcattaatccctttcatgagggttaaccccttatgacctaatcacccacaaaagtcctattttcctaatcccattgccttgtgggggttaggcattcagtatacaaattttggggtaacacaaatatccaggcaatagcaccacccttcagtgataatgaaagaatgcctaagtagtatcacagatgttgaattttctagtttcttttaatattaattttt

SEQ ID NO: 412603 - DNA, 475 bp, Homo sapiens
tttcccacattatcccattatttctatatccttacttctataagcaagcaaaatagtggatatattttccccctgaataagccccattatttctgtttcactaccttgatacatagacttccctcttcctgaagtccttccattctcgaatgttaggtttcactaaaggtcgggtcctgcctcttccttagctatccagcattaggtgagtactgaccttggaactcttatggtgtcagcatggttgctctttaaagatcatgatgaagaatccctagtctatttcttcctcagtgtgatgatctggttggctctgaggcttgtggatacttcctaaagcaatattgaagaaagaatgaatgactaaagaccttaatccaagtcaagtgcctagattttcaagttccctctctttatgaactatatttcacttatttccacaaagttttaaaaataaatacccaatgaacttaaa

SEQ ID NO: 412604 - DNA, 379 bp, Homo sapiens
ttttctctatgtttgcatgcgctcgtgtgtgtgtgtccaggcaagaacacattttataaaaataagaacacttgggctgggcatggtggctcatgcctgtgatcgcagcactttgggaggccgaggccggcggatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagaacaagactgtgtctcaaaaaacaaaacaaaacaaaac

SEQ ID NO: 412605 - DNA, 210 bp, Homo sapiens
cacttggcatccttttgcactaggaattgtgccaaaacatgccactaaggcattattccattttcaagtacgtgcacgccatattcagtcatgaagatcatagtaactcatgagtaactcctagtaattcttcatcactaacgatgtaaagaggagacaactagagaaatgggcatgttacgagaaaataaagatgaaagaaaaagagta

SEQ ID NO: 412606 - DNA, 317 bp, Homo sapiens
ctgataaattctatgaaaaaccctttgagattttggataggagtttatagattaatttgacaacacctgctgtcttcattttatcaaatctttccatttaaaatatcagacatacacccacttaagtaggtcctttaaatctcccaataaagttttataaggttccctttaaaactcttaaatatattgtattcgatgttcttatgtactttgtagttttgttgctattggaaattactttttttatgtaatttttttctctcttggagtggtactaaaataaaggaatgcatttctgtatattaatcttatagtta

SEQ ID NO: 412607 - DNA, 277 bp, Homo sapiens
tctatatatagatatagtttataagagtaggcttgagcaaaagagaatacattgtgcagatctaacacttatataattactagcaagctagaatgacattttaccagattaccagagtaatttataataattaaactggggggtgcagccaggagcggtggctcacacttgtaatatcagcactttgggaggctgaggtaggcggatcacttgaggccatgagctcaagaccagcctggcccaacatggcgaaacctcgtctctactgggaaaaaaa

SEQ ID NO: 412608 - DNA, 640 bp, Homo sapiens
caactatgcacactgagtataactgaccttatgagaacatcattctcactaagattatgatgtgctttctcacgtgggaactgtacataatattgcgtgtacacttgggaggatgtcctgcctgtgatgttgtctttcaggggaagaagaatggttgagaactgagggtatattaaacatttactcctccagatttttcaagatttctgttaagccagatcagaagaaacccatctatttggattgcatcactctaacctggtaagtcgaattgtctacacagaattataatttcacgatatgtccagattacttaccaagagccaatttgagacaccaacaggactagtaaaacatctttgcactgtgggtagcgttgctatcaaagaccttatacattatgccattcaagaacctttatattaagatccttatggaaaatccttcccaaagtttaaccctatgataaagggtttttttctcctggtaacatagtgggcaattgggaactgtttaacccaatgcattgatttcattgattgttttggttgccgagaagtatggatgctcagaataggttttcttgttttcaactgctaattcctttatttaaattgtaataaatgtttccctttacttc

SEQ ID NO: 412609 - DNA, 347 bp, Homo sapiens
caactatgcacactgagtataactgaccttatgagaacatcattctcactaagattatgatgtgctttctcacgtgggaactgtacataatattgcgtgtacacttgggaggatgtcctgcctgtgatgttgtctttcaggggaagaagaatggttgagaactgagggtatattaaacatttactcctccagatttttcaagatttctgttaagccagatcagaagaaacccatctatttggattgcatcactctaacctggaaataccaatattttctaagcatggcaagtgtttccaagcattcagaagtggagagtgtaggaaatccactgcagaatgaggtct

SEQ ID NO: 412610 - DNA, 454 bp, Homo sapiens
attagctattagcaaattaaaactgcatgagatagcactacatacctttcagaacagctaaaatgaaaaatagtgacaacaccaaaagctggcaaggatgtagagtaactagaccactcataggttgctggtgaaaagacaaaaggttacagccgttctggaaagcggtttggtcatttcctatgaaactaaacatgcagttaccagcattttactcttgggtatttatcccagataaatgaaaatgtgttcacacaaaaacctgtatacgattgcttgtagcaacttttgtttataaaaaaaataatggtaacaacagaagtcttcttctagtgaatggttgatcaaactctgatgtacccgtaaaatagaacaccgctcatcaataaaaaagaaatggcctgttgatacatgccacacctggagggacctcaagggtattgtgcttgccaaa

SEQ ID NO: 412611 - DNA, 421 bp, Homo sapiens
tgattgtattctttcatttaatcctcataacaaatatatgggaaggcctactaatgtccccattttatggatgagaaaatggcggcacagagattacataattggcccaaggccacaaagttagtaactggagaagcaggcatggaattcaggcagtctggctgtagagcatgaaggctaagccactaagctacctctcacagatcggcatttaaagaaaccagtctgattccatgagagttctcagatgtcctgattttataaataccaatataaaatagaccaagaagtcatgaagctgagaaggaatgccagtatatagcatgaacttgctatgtgttggaggaggccaaatctagtatggtcttaggctcctgaaaaagcctttggacaacaatgaaaacaggccttttgaaattgt

SEQ ID NO: 412612 - DNA, 442 bp, Homo sapiens
gtcaagttatcttcctccccaactagctgctccgcctcagtcccccttcattggctccttttgctgtagatgctggagcactgtggggttttactgcctcccaatcactctagtgtcctccactcccaggattttaaatatcgtctagacacagatggctcccaaatatatatctctacatatttctataatcaaaaaactaatggtaccaaaacaggtactctgatatattgcagatgggcctgcaaactggaaatgttttcaggaaaggcagtacggcaatttctgtctaaattaaaaatgcatacacccagtagtcccacttctagaaatgtgtccaaaaatacacctgcattcctgaaaaatgactgtattcagaattatatgttgcaaccctgtttgtaaaatcaaaaaggaaagaagaaagaaaatgaaagataaa

SEQ ID NO: 412613 - DNA, 437 bp, Homo sapiens
cagtgacatataaaaaggattttgcaccataagcaagagggatttatcctaggaatttaaggttggtttaatatctgaaaaatcaattaatataataaaccttatcaatagaataaaggacaaaaaccacacaatcatctcagtagagtcagaaagagctgggtgtggtggctcacgcctgtaatcccaacactttgagaggcctaggtgggcagatcccttgaggtcaggagttcgagaccagcctggccaacatgctgaaactctgtctctactaaaaatacaaaacttagccagacatggtagcacatgcctgtaatcccagctatttgggaggctgaggcaggagaattgcttgatcccaggagacagaggttgcagtgagctgagaccgcaccactgcactccagcctggtcaacagagtgagactccatct

SEQ ID NO: 412614 - DNA, 379 bp, Homo sapiens
ttgcctctcctcgtttgatcctcttaggccgtcctggcctgcgggtttggcagggacaatgccccatcttacagatagcgaaactgaggggagatacgtccagcagaaaggagaggagaattcccatctgcccgcagtcccggcctggaaagccctccgttgctgggctcagaatgtgacgggaccgtcgccctctttctctggctgcagcttctgctaaggggatggcagatgtcaaggatctccagaccacgggggagggagaccctggatcctgttctgggctcccctggcttccttttgcgaggtgactccaccctccccttcctgcctttttcccctacccctcagtgcacaggcctgggtgaaaaaaaaaaaa

SEQ ID NO: 412615 - DNA, 411 bp, Homo sapiens
gagaaggtcacatgaataataagaaagatttatcagaatgtttgtctagaacttatgtttaacttactgtatacacacacaaacacatttttctatatctgtaatcagtgtttttactgtagtttaaaggactctgagtctttcagtcatttaataaataaagcactccttgatactgttagtcatcaaaagaggttaagacagaaactgtgctttcacaaattttatagttcaattggaggcttaagatatgtctcttggaacctacccactatatatcagtcatgctaagctttatgaactgcacagacctttgagtagggtgatctaaaagacattgcataagacaaaggttttaagaatatcattagatgttagctgtacagaagagggattgtgaatatgaagtgc

SEQ ID NO: 412616 - DNA, 277 bp, Homo sapiens
aacaccaaatggcggatgacgccggtgcagcgggggggcccggaggccctggtggccctgggatggggaaccgcggtggcttcctgcggaggtttcggcagtggcattctggggccggggtcgcggcctgtggactggggcctggggcctgatggcctgcggagctcgcggaggcaaggccgaggataaggagtggatgcccgtcaccaagttgggccgcttggtcaaggacatgaagatcaagtccctggaggagatctatctcttctctctgccc

SEQ ID NO: 412617 - DNA, 381 bp, Homo sapiens
acttaagtaatttcctcattggatactaagtgctttctgtaggccaggcattgttcagggtcctgggataggcatgaacaaaatagaaaaagtcccgccgggcgcggtggctcacgcctgtaatcccagcactttgggaggccaaggcgggcggatcacgaggtcaggagatcgagagcatcctggctaacacggtgaaaccccgtctctactaaaaatacaaaaaattagccgggtgtggtggtggatgcctgtagtcccagctactcgggaggctgaggcaggagaatggcgtgaacccgggaggcggagcttgcagtgagccgagatcgcacagctgcactccagcctgggcgggcaacagagtgagactccgtctca

SEQ ID NO: 412618 - DNA, 1197 bp, Homo sapiens
cacggcgaccctacaagctacctgatctgtgcacggaactgaacacttcactgcaagacatagaaataacctgtgtatattgcaagacagtattggaacttacagaggtgcctgcggtgccagaaaccgttgaatccagcagaaaaacttagacaccttaatgaaaaacgacgattccacaacatagctgggcactatagaggccagtgccattcgtgctgcaaccgagcacgacaggaaagactccaacgacgcagagaaacacaagtataatattaagtatgcatggacctaaggcaacattgcaagacattgtattgcatttagagccccaaaatgaaattccggttgaccttctatgtcacgagcaattaagcgactcagaggaagaaaacgatgaaatagatggagttaatcatcaacatttaccagcccgacgagctgaaccacaacgtcacacaatgttgtgtatgtgttgtaagtgtgaagccagaattaagctagtagtagaaagctcagcagacgaccttcgagcattccagcagctgtttctgaacaccctgtcctttgtgtgtccgtggtgtgcatcccagcagtaagcaacaatggctgatccagaagttttcagatgaggaaactgacgggtaccaagcttaaatgacttgacgaagctcatagaagattagcaggtagtagaataatgactgctgactcctaattcagtggatcttccctggccaccgttttgtattgagctgcaatgcttccttgactggttctccacgccagattcttatcaatgatctttcacctaagaaacagcaaagattctggcaagcacacgatctagagatacatcttattgcgatttttcacaaaaatcaaaagaagaaagaaggcttagctggtgtttaattattgttatttttttcaatagggaaatctgtacacaatgatttatctccagtgatttgccattgatcaatttttttctcatttcattttctatttttttgttttttgtttttcttaattttttatttttttctcctttttctttttttaaattttctgtttatcacaaatgatcatgtaattatatgttaatactatgtaaccccagtgttttcaactgtttgtgattcaatgttacccagttttcttttcttaattttaaataaatttgaaaaattatct

SEQ ID NO: 412619 - DNA, 119 bp, Homo sapiens
atgcaacatatctcagcattcttgctgtgctctctgctgacttgcaggcgaggccgactgtgctgatgtacgtgacaagaggctggtttttaataacgaatgcagccaggtgcagtggc

SEQ ID NO: 412620 - DNA, 462 bp, Homo sapiens
cgggggcgctgcccggtggctctggccccgccgggccgttggcccagcccgccggcccctgagctccggtagcccgccgctggagaagctgttcgcccggggcgggcccttgcggaccttcctcgagcgccaggcggggtctgaagcccatttgaaggtcaggaggcccgagttgctggcggtgatcaaactgctgaacgagaaggagcaggagctgcgggagactgagcacttgctgcacgatgagaatgaaggtttaaggaaacttgcagagaatgaaatcactttgtgtcaaaaagaaataactcagctgaagcatcagattatcttacttttggttccctcagaagaaacagatgaaaatgatttgatcctggaagtaactgcaggagttggaggtggccttagacatgcatctgccagcattgggggttcagaagcctataggcacatgaaatttga

SEQ ID NO: 412621 - DNA, 173 bp, Homo sapiens
tcccccagtcttgccccatcagcagagctgagaccgataccacaatcactgccatcaagtggggcggctcagcccagaaacatggccctaggatcctccttaatgggataaagagtagaggccccactgtctttgataaggcaggcaggttccactctccaacctgaaaagat

SEQ ID NO: 412622 - DNA, 236 bp, Homo sapiens
aataccccacttcaaatcatccactgcagtgcacagactgggggctggtgggaccgacatcgatggagtggttactagcagccagacactaggcagatgaccacacctatcatcctcacagacctctggggtggcatcaacgtcagcattgtcaatgtcatcatcagcatcatcatttctgaggctccaagattcccaagttacttacccaaagcccaggcctgcctgcaccttcc

SEQ ID NO: 412623 - DNA, 300 bp, Homo sapiens
ccagccagcttcacctctcactggcactcaccgcgggactttgcggcacctaccccggacactccggcagcccagagggagctcgttccagacaatcaagaggaaaatagggaaagcgagaaagagacggagacctgctatcatggtcaatgattccacgaatagggaacagcggtccaagcatgggattcagcctccgatcaagcccagaaggagctagccggccgtgaagactgcggcgcttgcccagcccgtgctcacctggaacccacaccagcccgcgagcaccacgcacagccc

SEQ ID NO: 412624 - DNA, 390 bp, Homo sapiens
ggtacgaccgtggctttcaccgtggtgttgttagcgagcttcaaattaatgacttgggatcctgctgtcttcacagcagacactgggaggaaagcagtagccacaggcttgattgtgacctgtttaggggtgggctctgcagaggaaactgcattggtcaccactgcagactggagaggcaccctggcgggagaggaaagggtggcagctgatgcgggagacgacagaagggatgtcacagaggccatcacagacaccgtctgctcggaaggtttcttcccagagtcaagatccacttctggcaataccctggtcactgttctcttgatttccccagaagacgtcttagtggtttttatgcggactttggggattggtggtgtggaccct

SEQ ID NO: 412625 - DNA, 439 bp, Homo sapiens
aacagaaagttttaatttattcaacagacttttagaaagtcaaatcactctacaccattggtgactgggacaagtctgcctccatgagacatctggcaatatctggagacatttcagtttttgttgttgtggggttctgagacagggtcttgctgtcagccaggtgggaatgcagtgagccaccacagctcactgcagccttgacattccaggctcaagcaatcctcctgcctcagcctcccagagtgctgggattgcaggcatgagccactgtgcccatccgggatatgattgccttataatgttttgaggtgtgggctgtggcatttacatgcttaggcctttgtcagtttttggatatttatcttgtggtgaggtaaagtgttctgagcaaacaaaatgtatgtgagtgtagtctttttaccggctattgtagagt

SEQ ID NO: 412626 - DNA, 226 bp, Homo sapiens
ctccccaagccatactgacaactgactttctgctttcacctttgcttgtaaattctcccttctcctcattctcctttaatgttagacccattctccagtcttttactttttctccagtcttttactcttactcgttttcttatccattcttatttaccccatcacatcattgcttaaccgctgctctgttcctattttcgcttcaccctctttttttttttttttt

SEQ ID NO: 412627 - DNA, 127 bp, Homo sapiens
gagagaggggggtaagagtcagaagcttatgttgtttatgcggggaaacgccatatcgggggcaccgattattaggggaactagtcagttgccaaagcctccgattatgatgggtattactatgaag

SEQ ID NO: 412628 - DNA, 459 bp, Homo sapiens
tagcttctaatactgctttaaattcttatttctgcaaatcacactttttaatttctgagagccctttctgggtcttcaattcttcctttttacagtatcccatacttgttttacagatacacatcttctcttattgctctgagtatattagaggtattattttgtttttcttttgttccctgcggtaaaagctaagcttttaccgcagcactgctggtcaaatcactcaggtctgtgcaacactagagaagaaagctcctaaagcagaatcgttactacaaccaaaaatattccagaaaaccttaacacagtcccaaatatgacagacaagtgttcttcataagatcagtaaccacgaggtcatgctgcttgctggtcttctaccctcacaatactaaatccgcaggattctcggtctggtgcacgcccctgtgccaggcggtaaaagcttgggtaccg

SEQ ID NO: 412629 - DNA, 488 bp, Homo sapiens
acgccctcattctctctaggttccggaatccctctccaaatggtactaactacctgcttttcatatctctggatctcatttaaggctcattcaagccaggcgctgtggctcacacctgtaatcccagcattttgggaggctgaggtgggcagattgcttgggctcaggaaagtttgagaccagcctgggcaacatggcaaaaccctctctctacaaaacaatacaaagactagctgggcatggtggtgtgcacctgtggtcccagctactcaggaggctgtggtgggaggatggcttgagcctggtaggtggaggttgcagtgagctgagatcacacaactgcacttcagcctgggtgacagactgagaccccatctcaaaataaataaataaataaataaagttctgtgattggggtcaatggtaaatctcctgtgtgcgcactttatttcccattagacattgcggcaaaattcagtggtcagtcc

SEQ ID NO: 412630 - DNA, 548 bp, Homo sapiens
catctgcgtcccatcaggctcctgggtagcaggattacaggcacccgccatcatgcctggctaatttttgtatttgtgtagagacaggctttcaccatgttggccaggctggtcttgaacttctcacctcaggtgatctgcccgcctcggcctcccaaagtgctgggattacaggcgtgagccagcatgcctggccagtggatccttaattgtagcctttgaaggatgccctgtgtagatcatcattcagtgccacaaattgaaagctcccacgtttaatgttatcctcttgctatataaatcaagcaaatatatttaggccagggtctcactgatgggagcaagaaccaggtaggtgccaaatcctgggctgccacacatggctccaaagaaagagggaaacccagtgatctgcaggctttttttttttttaaaagaatctctctgtgttgcccaggcgggtctcgaactcctggtctcaagcagtcctccggcctgggcctcccaaactctaggattatagatgtaagccactgcgaccagttgat

SEQ ID NO: 412631 - DNA, 415 bp, Homo sapiens
actgggttagcttcctgcaaaacagacacctcctctaccctagagagtgatgtacagataaattcccccacattgaccttgaggggagggtgactgggatgcagggcctggaggggacctgcaccttgctgcagtcaagggaggcatggctacaccaagcctgcagagagccctgaggccaggccaggcacacggcaagtgttcagtagagagcccgtggtgacacagagacctcttctatgcaaatctcaccaaactcctgataagagatgtctgaaattagaggccaagtacggtggtttatgcatgtaatcccgacagtttgggaggccaaggtgggaggactgcttgaagccaggagttcagttcaataccagcctgggcaacatagcaagatcccagctaccacattaaa

SEQ ID NO: 412632 - DNA, 449 bp, Homo sapiens
cctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcaggaggctgaggcaggagaattatttgaacccgggagatggaggttgcagtgagccgagatcacatcactctactctagcctgggcaacagagtgagactctgtctca

SEQ ID NO: 412633 - DNA, 654 bp, Homo sapiens
gccttttggccggcaccgccatcttccagtaattcgccaaagtgacgaacacaaagagaaagaggagaggcacccgatatatgttctttaggccttttagaaaacatggagttgttcctttgtccccacattattagtgcgatagtcgtaataacgaatagggtgaatagttgtaagacatctaatggcgaggtggttacctgtgtcataaaagaggaaatgcctcccacaaggtgtttacgcatctggctagaacgtggcaataaagtctacgatattgttaccccaatccaatgcctgtgtgagcttactctgtgtgtagacaaacaacgttaacgggcaaaagttctgtgcgctagaggacatttccttggtgcagtcatttgagcatcgtctaacgcatctcgtaagtagcccggtagatagtctctcgcttgaaaacgtgtgtaacggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaataataaaggacctctgggctacaaaaaaaaaa

SEQ ID NO: 412634 - DNA, 573 bp, Homo sapiens
gccttttggccggcaccgccatcttccagtaattcgccaaagtgacgaacacaaagagaaagaggagaggcacccgatatatgttctttaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacacacaagttaagggcaagattcttgccaagagaattaatgtgtttattgagcacattaagcactctaagagccgagacagcttcctgaaacgcatgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaataataaaggacctctgggctacaaaaaaaaaa

SEQ ID NO: 412635 - DNA, 372 bp, Homo sapiens
ggacaaagggtgaataaaatgaatgaattacaatgaacaaagaaaagtgcaaaataacactaacaagtaaatattacaagaagataaccttgtggttaaaagataaggaaaaatatgagattatgagaaattaaatgtatactatattttaattaaatgaatctgtatttgtagcactaagagaattattattaaggattgactagaaccttaaaagatatatgtggatgtttgttttgtacggttgtaaaatatactagacctattacatccacctaaagtataatgccatgtaagaaaatgctttgacagtatcaacctgtgttaaggtatttctttccattgtaaattaaaagtcattttatttgacag

SEQ ID NO: 412636 - DNA, 293 bp, Homo sapiens
attctttgagagcaggaattatgccttattttttttcccagcccttacctcaattcctttcatatactagtggtttaataaattttcaactgaataaagttatataagctttaaagcaaatgtatgatattattggaatgttttcaacaatttgttttaagaaaaggttcttaaacattatttaaagtagttaacataaatatgtaattatatttacttcgtttatttgcaatatatgctaaattggtgtagaaccatttgtaaaattgtattaaaattcatctgaaaattta

SEQ ID NO: 412637 - DNA, 400 bp, Homo sapiens
atttattgataagaaaccaatagcaaacataatacataacggcataaccttaccagtgtcctcattaaagtaaaaaaaacgagacaaagatgtccactgtcatctccactattcaaccttgttctggagttttcagccaatacagtagaagaccaggaaaaagaaaaaagaagtacacatattggaaaagaagagttaaagttggcattaataacagatgatctgattgtctacctataaaattcaagataattcatgataactaatactagagttcagaaaattggctggacaaaatttaaacttgcaaaaaaccaccttcctatatattaacagcaaccaattacaaaataaaagaggtatctagttacaattgtatggaaatttataaagtacttag

SEQ ID NO: 412638 - DNA, 926 bp, Homo sapiens
tcaaatatttgtaaaatatcttctatatagtaggatgtttttccttttatttattagtaaatttaccacaatattaatttagttagtaaattagaatttttctttcccattcatcatttatgtcaccagcaggtaatcctactccatcctcccaccacatctcatttcattatcacctggcctccagagggtggaatcacttgggcactgctcaagcttatgagatcttaaaatttatttttaaaatatttcaaatcaaaaagtttttgagctgtgaaatttaataagatattgagctttcttctagccttttatccactaattctactcttagaaattacttcctaaaaaaatactttttaagaaaaccacacacacacaaaatgtcctctaactttgttcttttttcttccaagttgttttgtctgttctagatcttctgcactttaatttaaactttagagtcagcttgctacttctacaaagtagctggctgggatttctattagaatgccttgaatatacagatcaatttggaagaaatgacgtcttaacaatatagagtcatctaatctaggaatatggtatatttcttaattgacttaggtcttctttaacatttaattttactcaggcaatgttttatagttttcagtgtacaggtcttgaacatcttttgtcgaatttatccttaagtattttacagttttgatgccactgtacatggcaaactttaattttaatttctgattgtttattgctaatataaagaaatgcaattggtttttgatattgactttgtaccctgccactgaactaaactcactttcagttttaacagcttatttgcagattctttagggttttttgatagatgacaatatcgtctgtgaataaacagagatttatgtctccctttccagtct

SEQ ID NO: 412639 - DNA, 342 bp, Homo sapiens
caggcagagccctagaaacgaagcaacttgacggggagatgtttgcagatgggcaccagagtccagccttgttattattagggaagaagtaaggcagacaaactcagggggagagcagagcaccctggcgtgaacacaggaagggaaaggagcaaagccaggccgggcgccagggatggcgacccgagcaggtgggagaggccgggctgacagtcagatgttctccactgcctggctcagcagtctgaggcctgcaagccggagaggaggggacagagcatggggggctgacagcagcgtcgccgaaaagctggcagagaacaggagagaagggcggccgct

SEQ ID NO: 412640 - DNA, 421 bp, Homo sapiens
ctattctgtcctgtgtgtatattgagtttttgctctataactgatttgacaacatcaacttatttcatgattaaatgaggttgtaaactttcattacatttatttccttgggaaaaacaaagggatggaaatactcctccttgttcagtggaattgctaggtcttaaccatgatggataatctttaacttttggttactacaatgttttcaagcatccattttgtcatatagagaattcttaaataatttctaagtgaatgaaagaattgtgtttgttgatatgtgttgatagataatatactttccttaaagatttctttaatgtgtgttattggatagagggttgagaaaatatacatgaaagacacattggaaataaggcaaggtcagtttctatttctaataaaacattgaaggata

SEQ ID NO: 412641 - DNA, 1925 bp, Homo sapiens
  misc_feature (969)..(969): n is a, c, g, or t
agcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtttacagggcctggaggcccagtcttgtcctcctctgtcaccgacttgctgtgtggacctgggacactctcttcacttctctgggtctcaattcatttactgttgaacacggacaatcatattcttccctcctggctgggaggactacaaagatctgaggaaataatggatatgaaggggctttggaaagtacaaagccatcttctcatgaggggcatgacagaaccctctttgcagagtgacctttggacgtgcagtcagttcttggagaagtgtggcccctgcagcagtgtcacggagaacacagagttccagagagcaagcctggggcaggggctgtgcaaacgtgtggtcagaggaacatcaaatcctggaaacttggtggcagggagaggcctggggcctttaccccatgccccctgggatctccactgtgactgtcccacaccctctgcccaactcttgccccatcagctgccctgcattgccttgagctgggacccctaggaaatggaaaccaggctcccctctctcaaggtatctgggaaccactgtctcaggagctgaagccnggagacctgaggggaggtctggccggagagtccgtgcgtaaagcagctacagctctgacctctctgacctgcagcctctcagggcgtgcgaagtccaaacgcactggcaacttcaccccctttgccctaacgcgggcaggctgacttggaggggtgcttccctatttacacctcagggtgaatttgttgatcaccttagctcctgtggtccttggggcttagggagaggagggaggcatgcctgggtcccaggtaagctggcaagaggaaagggccacaggctaggggaataacgaggccatgaacaagacatctcaccccagttacaatggcttttatccaaaagacaggcaatgacaaatgctgatgagaaagtggagaaagaggaatccccatatactattggtgggaatgtaaattagtatagccactatggagaacagtacagtttcctcaaaaaactaaaaataggctgggcgtggtggctcatgcctgtaatcccagcaccctgggaggccgaggcaggtggatcacttgaggtcaggagttcgagaccagcctagctaacatggtaaaactctgtctctactaaaaatacaaaaattagctgggcgtgctggcacgtgcctatagtcccagcaacttgggaggctgaggcagaagtattgcttgaacccaggaggcagaggttgcagtgagctgagatcaccccactgtcctccagcctgggcaacagagagactgtctccaaagaaaaaaaaagaaatagaactaccatatgatccagtaatcccactgctgggtatctgtcagcaaggaaatcagtatattgaaaagataccagtactcccatgtttactgcagcactatttgcaatagccaagatatggaatcagcctaagtgtccatccacgaatgaatgaagaaaatgaacacacaatgaaatattcagccat

SEQ ID NO: 412642 - DNA, 405 bp, Homo sapiens
tctactaaaaatacaaaaattagctgggcctggtggcaggtgcctgtaatcccagctactcgggaggctgaggcaggagaatcacttgaacctgggaggcggaggttgcagtgagccgagatcgcaccattgcactccagcctgggcaacaagagtgagactgtatctcaaaaaaaaaaaaaaaaaaaagaaagaaagaaagaaattgtgtagcagaatttgatctgaaacctatatatacaggaagtggcaaactctcagtcacccaagtttctttggcagatacttatcaaaaagaaaacaaaacagaaaacgacatcgtctattatcttttgcttacttctactctctggaacttcactgctcttgtagctcagatacttgctagcagttagtttctcatag

SEQ ID NO: 412643 - DNA, 435 bp, Homo sapiens
atttatatacagtaggtacctcataacaaatgttcattgatttaaattgtttcaattgacaccaaatttactactatgcacctacactaaaggtttataatgtattctatctgaaacaatggtttttctagtcatttttaaagagacttctcgtcttgaccttcattcttttggagagtacaggggaattcacagagaatcccttgaattacaggcccacatgagacaccaaggcaccaaatcctcacctttgagatttataaactgaattcaataaagactttatataatttgcttcacatggacatggaatacttgacaacatacaaatacacaatgttgtattattacttataccatagcttgaaacctattttctacgcattccttaaaattttgataaaagagctgtgagaaattgggtatatgttacaa

SEQ ID NO: 412644 - DNA, 252 bp, Homo sapiens
cacgcatatacacacgcacggccacacacatgcacacagcacacgcataagtgttcacacatttgcacacacctttacacagacttacagacatacatacatgcacatccacctacatgtgcacacacaccttccccaacacaagcacacatacacacactcacagttgggccgtggctgctgtttctgaaacccacctgcttgcttattcaggaagatgaaacaaccccggcctattgttgactctcctag

SEQ ID NO: 412645 - DNA, 895 bp, Homo sapiens
gaagtcaaaatgacacaggttaaaaatgaacaattatgaaaacttactcttttcatataccatttgaaactagaacacttctttttttctgctaattctttcaaaaaagctgctagattttgaaggtaactaatcaactgatgccaatacagacttctggaagatggatattgattgacattgattctggataggcagtcaaaaagtgctttccttcttgtgttatatgcatgtaaatgttggctaaattgttaagacatttcagaaagtcacttcaaactatcaaaaacacagtccccatccatgttcctcgagtggaggcaggaatgtgtttacagccactttacaatccaaatgtgaactgcagaaagttttcaagttagtgtaagtttacattttgagtttatattttaacttgtcaaacttttattattgacttgtaataataaagatttcacctgctgcacatatggtccttaaaaacaataattttattgatgttgggccagcttctaatacactaggaggaacaatctgattttatttagacaaatgaaatccataatttgcaaacatgccgaagctttgctttatagtggttaattataaaatgcactaagtgaatctctctactgtgaaagactccagtgtgcttcctaagctaaactcaggcaacttaacaagtcaagaccaaatattcagctgagacttaggaagtggttgagacacaacagcaaagccgcctgtgttttggtgtggttaaaaggtgttccctggttgtgctgatctgtgtgtgactctgcttctgtagatgattagattaaacacggccatattttgaaaagctgcagaggttcttgaaacaccacagaccaaatccaaatacacagaatca

SEQ ID NO: 412646 - DNA, 484 bp, Homo sapiens
tctgtcatttttgaccttgcctccgtcttacaaggatccttgtaattaattatattgggcctgctgagataatccaggatattcttcctactcaagttcctcaatttaatcacatctgcaaaaactgccttttgctatagaacaatgacaggagattagaatgtaaacatatttgggggaccgttattcagcttaacacaatacgtcccccttcatcaggtggagcttattttccctccttccttgagtgtgggctggacttagtgactaacttccaaagaacagagtatggaaagggaggaggagagtaacttcatagtacagaaacctggaaacactgtcttggccaggtggtcaaagttaatatcatcaagtcatgttgatagcatatactcccaatatactgtgatgagaagggcaattcacctctgtggtattctcaaaacctataacccaatctagtctaaacatgaaaaaaaaaaaa

SEQ ID NO: 412647 - DNA, 463 bp, Homo sapiens
aacacaccccccagtcctcattagcaccgaaggggaggctgaggactccagaaggccatgcagtgagtgagacatggctccaaggggtaggttgctggtgctcattccaggagagagcctgctgggaggaggtggttgaccgacagcccccagctcctgtgccttcaaggtccacggcagcttttcacagaggctgaggaccaagcatggccagtgggtgctggggcattgaacaaataaatgaaaagatgaatcctggagaaaggagctcctccctgggcagtctgaacgctggggccttctgcggagtgtggccaaggctctctcagagctgtaccgcagcctggggctcttcctgtcccctcctccctttctcaggtccctgagtcctgatctgagactcccccacctgccccacctcctttccctatgttccccaatggtgtttccctcaataaatctc

SEQ ID NO: 412648 - DNA, 430 bp, Homo sapiens
cagtcttctctgttggaacctgtaagccccacactttggatgttgggggagacaaagggagggtcttgatgtgtctgacccaggggactgcaaagctttcaatcctcaaatccttgtctccaggttcatcccctcaaccagaagtatggaatccctccttcctgcctgcctggtccctcaagccaatgagctaagggcacaaggggcgaacccaggactgaactagccaccggcccttaggacgctggtcacccacagagaagaggaggtagggccccgcctgggtttcttctgccagcgtcagctctccacttcagaacacacaaagctggggcctccaatccctccacagccacagcagccatcggggctgtgggtggatgcagttagcaagagatatttataaatcagacgtttgtaaagccagtgt

SEQ ID NO: 412649 - DNA, 326 bp, Homo sapiens
  misc_feature (39)..(40): n is a, c, g, or t
tatctagaggatcccggtatcaattcatgtaaggtggannataaaagtatgaatggagaaaaaaaaacaaatactgtatgattccacttacgtgagacgtctagaatagtcaaattcatagggacagaaagtagaatggtggtggccagggcaagggacatgtgggacagggagttattgtttaatggctataatacaagcttcagttctgcaagatgaaaaagctcttgagactggttgcaaatatacctactagtgaattgtatgcttaaaatggttaaggtggtaaattttatattatatgcctttaaccttaattagaaaat

SEQ ID NO: 412650 - DNA, 213 bp, Homo sapiens
gctgccttatatcacaggtatttatatatatacctttttcctaagttgtattatgaagtggtggagaacagagaccagatcttatatatcaaagcatttagaatggtgattgaacatgggagctatttaataaatacttggtgaaagaataaatgaagaaattgtcctacgaaattaaaacaccctagtgtctttgctttacccactcatggc

SEQ ID NO: 412651 - DNA, 481 bp, Homo sapiens
tagataaactttgaaaatgatttgtagagatgaatatcctcagccatccctcatgcagctatttccatggtatgacatggcaattacctcacggtcaagttctacttttgtttattgtatcaaaacctgatgctctcgaccagaagtgctgggattacaggtttgagccaccgtgcctggctttttgatatagtctcgttttgtatttatttgtttttaaaaccacgtgtaatttttaaattgagatttactttttttcactttgcagaactattagtaatagctttttcaggaccaaagtacgaagaaatttgggaaaggactggtctttttctcatgctctgaaaccttcaagaatataaaactaaagtattacagactccattacgttactaattgctggtagctgctaaaatgtaacactgtttatgctgattttctgcaaccatggaaaaagtactgacaaaaataggttttgcat

SEQ ID NO: 412652 - DNA, 294 bp, Homo sapiens
caaaataataataataataataataataataagcccctgaaggtattacacatgcagcactttccagtttaaaaaggactttcaaaggacaagtagtgtatggtcccatccataggaggtatccagagtacccaaatatagagatgggaactagcatggtgggtgccaggggctgggggagggaggaatgggaagttggtgttgaatggggacagaatttgagttctgcaagatgaaaaagatctagacatgccattgcactccagcctgggcaacagagtgagactccgtctc

SEQ ID NO: 412653 - DNA, 718 bp, Homo sapiens
ctgggaggcaagagacagcatggcattttgacattgtcagccactgaaagaagccgatgtggtggctctgttgtgaggtgaatggaaatagatgaggctggagagtcgggagtgggatgttagatcaccaagcccctctgtaagtctccaagcaggtgggatccaaggaaagaatgaagatcttttcgtggccttcctttgtggaggaactgtgtgtgtatttgtatctatgtattgtgtgtgcacacatataatagatacattatacatattagatatattgtatacgtatatacacacacaatacacggatacatatgcatattatatatcatatatacatgcataatacatatgatatatatacttagatacatacatataaatatgcatacatgtgtatttattttttagggctcattatttgattcagaattctatcaggcaggcactgtcctctctttaatgggatgtagcactaactgggttttagacctgcagtggcccagtcaccctactgtaggggaagctcctggatctccaggggaaatgtcactgaaaggctctgtgcaaaaaggaacttgacttactgggtatttatttcctttgatctgtgaaatgtaaaactgagctgactttaagcataagaaaacattaaaaactcttcattaaagaaagaagaaactactaacacattgacctgagctaaaaaaaagag

SEQ ID NO: 412654 - DNA, 524 bp, Homo sapiens
attagaaatttttaaggtgctatttggcattactctgattttctatatcagcactatatttttgtatatcatcctatcgataatgttaaaggctttggaatggtttgttaatccaaatttattctctggcaaggtgaattttttgcattgttaaagaagtgagatagttgaaggcatagctactagtgtaacgcatatgcccaatgttgggatttagtccttacagggaaggaaatgaaagcaagagaaactgatagtaagcttttttccaatgtgattgcttttgaaggacctcgtagtcttgaagtgccttaaataaactttgctaaaacgtttgaaacaaaacaaagattagaaaggtcagcaacatttgggcagctcagagtttcttgttttattctttaaaaatctgtatttcgttgtttggctaactattcactttattgcttttatatcactagataagatcccaagttagtacttatagtcaaatattcttgaaattctttaacaaacaattctgt

SEQ ID NO: 412655 - DNA, 467 bp, Homo sapiens
gaagactgatattttatatcatggagaaaatttgagatttaaagcccttgtgtgttcctacaaaaacaaggtccttagagtccacctctaagaacaaagatggtacccattcactccaacctaaagctcttcgactacagcaagatggctgaattgtctccccccaaattcagatgctgaagtccttactcccagtacctcaaaatccgactgtaggtggagttagtgtctttaaagaggtaattaaattaaaggagatcagtaggatgggcctgaatccagtgactggtgtccttataagaagaggaggttaggacacaaaaacacagagaagaccatgtgaagacacagggagaagatatccatttgcaaagcaaaggatggggctcggaaaaacctaccctgccaataccttgagctggtactccttgcctccagaatcgtgaaaaaataaattcctgttgttt

SEQ ID NO: 412656 - DNA, 515 bp, Homo sapiens
tagtttctgaaaccgaatcaaagctcatgatgtgaatttaaaaaacacataaagattagtctccttaaaatgagaattggatgtatgcatagacataaatatacattctatacatatataaacacatttctataaaagttgattgtctttttgttcagaggtggttttataaatataatagcactctcatggttaatattatataactggagcacttagaattttttaaagtatttacaaatccaccccacaaaaacttttaataaataaacctaatcatgcagtcagtcttggaattttatttagcaaataatactcatcagaaatttattttgtcaatttttatagaatacctttactgataatatttcctagatgtaaatttcttaaaaagtaaagttcttttcagcattagtctgactgtcccaccaatggcctcttgcctaggaggaggaaatgagtaagagttaggaaggctatgcttaaaatcaaatgccattttgaaaaaaataact

SEQ ID NO: 412657 - DNA, 471 bp, Homo sapiens
acaattctgtatttttcaaattttcaacagtgaccatgagtcacttttccaggaaacacgttttaaacaggtcagaggatttaacacatccaggacccatctgaaggtggacttgagcagccactccatgtcagccaaccttggtcagcataagtgggggtgcaattatcacatagaggctgtcctggaaattattaaagagtcattaaaggcttttagtgtttttttttgtgtgttgtttttaattgtcagagattacgactagcatagattaacctaaatagtgtggtgtaatctcttttatggtacccctcatttcatccctcctatctatgcacagatgctaattgaatgtgagaggcagtcaacaaatgaaacttttccatgctaatgttatggaaaggcagaattacatcaagagacttcagtttaaccggacctcaaaagaaagattaaaaaatatgaatccct

SEQ ID NO: 412658 - DNA, 915 bp, Homo sapiens
ctatgtcctttgggtcttgtgggtgaagcattcttgggactcctgccctacgctcagctgtagctctgggcccaccatgtagcttatccctccccagggcacagggcttttaggattcccccagtttcgatggtttctactcgtgccctaagtgtgacagtgttttttgccttttttgcctttcctccagcaatctaagggttttgttccattgaggagaataacctatgtaggttttgtacctttgggacagtggctgctgttcccctctgctgggcctacaccacaaagagagcatcccgtgaaatccacggggaccttccagtggatgtggatttcccttcactccgcagcccctggggcttctgtgctctcccattaccccacaccgacccttgccaactcattaaacattttggctgtgttcttcttcctggtgtctggcctcgtctgtctcggtgacagcctgcatcccgtctcctcctgcaggcgcctgccttccctttgttttgggttagttggttgccctgtgacctcagctctcagagagttttgagaaaagtcctgacttttcaggttgcttggtgccttttgttgctgctgcagtttaaggatgggagccgggctctttccagctctctatgtcctaagtggaagctgggagtcacctctgaccttcactttccccagagttttgcaaacaccttcacactgggctcctgctaggtcctcctgggtgggcagcaggcgtcgttagctcctgtacaagtggggcagatggggacccaggggaggggaccagcccagctgctgcatgacactggtggagacggtccagggccctttctcatcttggtggtgctggtgctggctggtgtttcaggtgtgttttgaaggaggtgggggatctggagc

SEQ ID NO: 412659 - DNA, 491 bp, Homo sapiens
actccatcctgggcaacaacagcaaaactctgtaaaaaaaaccaaccaaccaaccaaacaaacacaaaaacacatttatcctaatgttttttatatatccttagtcccaattgctttcttttctatgcctttttatttcattttttaaaaggatttttttcaaaataattatagacacaggaagttgcaaaagcagtaccaagaatttctcgactcttaaaaattattgaaggccttggctgggtgcggtggctcacgcttgtaatcctagcactttgggaggctgaagtgggcagatctcttgaggtcaggagtttgagaccagcctggccaaccagcctagtttctttagtagagaaaccccacatgcctgtagtcccagccactcgggaggctgaggcaggagaatcacttgaacccggaaggcagaggttacagtgagccaagattgcacctctgcactccagtctggatgacagagagtccatctc

SEQ ID NO: 412660 - DNA, 409 bp, Homo sapiens
agacagagaaagcatcagaaccagactgagctggaataatcagactggaaatttaaaacaactgtgattagtatactaaggtctctaatgaataaaaagcaagcaagatgtgcaatataagcagagggctagaaatccacgaaagaaacagaaatgctagagataaaaaacattgtagcagaaatgaagtataccttttaaggacttcttagtagactggatatggccgaggaaagaatctctgagctttaggatatctcagtagaaacctccaaaactgaaaagcgaagagaaaaataaccagaaaaagaaaaaaacaacaacaacaaaaaaacctgaactgtaatataatatctaagaattgtggaacagcttctaagagtataacatgtaatgggaatactagaag

SEQ ID NO: 412661 - DNA, 455 bp, Homo sapiens
agccagatgttcttcagtgggtgaatggttaaacaaactgtggcatatctgttatcatagactactctgataaaaaggaaggaactattgacacatgtaacaccctggatgaatctccagagaattgtgctgagaacaaagagttaatccccatatcatatcatttatataacattcttgaactggcaaaattattgaagtagaaaacagactatgggttgctaggggttaaggagggatggccataaaacggcaacatgagagatacctgtggtgatggaatattctgtatcttgactgtatcaatgtccttatcttgattgtgatattgtactatagttttgcgagatgttcccattaatggaaactgggtaaaagatatacaggatttttttctgtattatttattgtaactacatgtggaaccacaattatctcaaaataaaaatttaatt

SEQ ID NO: 412662 - DNA, 458 bp, Homo sapiens
attctttcctccagagtcgtggggaggacaccagccagatgtccctgcgggtctcctcagctcctgagctcctgggagtgagaagaagtttcctggcatgggcagcctaattccaggagggaacggtcctgggaaatgcccagtccacaccatgggacacggcgcctcggcccgaagcttcattatttgggtgatttcgctgcatgcaaggtttggccatccccccgggaccaaagggagattggaagatatcctcatacctacctcagaaggcaaaacctctttagggcttaaaatgtctgcctttccagcttcaaaataatgcgaagtcacatcaggcgccttctgcaggcccggagcgcagggaggggcagtcaggaggcctggttctgttgtcctgttgaagagcagatgctgttgatgtgctttttgtgagataaagcagccctgcaacatgc

SEQ ID NO: 412663 - DNA, 527 bp, Homo sapiens
cagtgacatcaggccttgccatgctctaagtgagaaaaccttccaggctggtcattgcctccctttgctctcatttcaagctcatggaacaatgatgagatgcttcattcaggctggcaggaacctggtgccatgagggagtgtcaggtgggtgctagaaggcaggcatgagctttcgaattacaggaaatgaatcctgtaacaggccttctcccaccctgctgcctacaaataggcacactgacattctggtttgtatatcagtcacttatgagcttggttagtgtgagtcagtatccctcaataggagtgatctccagtgggctgacaagactgagcttctgaactagcaaagctaaaaggcccagatgccagtttgtaatgccaatccatggccctgccttgccaggcctctggtctcctctctgggaagcttctgttacattctgaaacccagctctccacaggaaattctgctctctgtgactgggagccagctaggcttcccagtgaagtacctgcaagag

SEQ ID NO: 412664 - DNA, 483 bp, Homo sapiens
tggtgtttgtggatttgtgggctgagattcttatcaaattccggaacttgcaatgtctcaaggtaattgtttaaaatattaattgttttactcacactgcaaatgttgatatagatgctggggtggaggtggggcaataggccagaataagcccaagaataccttggaatttgctgaatttctttctttttgcataatcttattcacacattaacataatatgaaccactctggctccatgagcagcacagaagagactttctgcaaatgtgattattagggcaaaagttaggagattttttgcccccagcttttctcctctcctaaaatctttttttttttttcatttctttgtcagtgtctttaatttttttagctgcatttaaaaggctttctattatttctgcatgagtaagagcatgtgtcatgtcagcctccttgtcagcttctgtttcactttcattaaatttgttgattgagtgt

SEQ ID NO: 412665 - DNA, 386 bp, Homo sapiens
taggttaaatcttaaaaaaacaagtttgtccatttaggtctagtatactttagccttcatgtattgactgagtgatttgctttttaggatcaacattttttaataaaaatctgaatgagtaactctcctttgggccaaaggacaaattgggaacagtctgctctgaagttcatataaataatatttacccaagcataaaatgtgtgcttggaagatataaactatataatttatgcctaaacttattttacattgttttgattcccatccaaaatagaatgtggatcctgattgccttgctgcatcttatactttgtcgattagtatacctagtaatatccctttgtcttttttttcacaactctcctatcatctttcatgagcac

SEQ ID NO: 412666 - DNA, 405 bp, Homo sapiens
gaggaatcagaagacaggaagatgtgagaaagtttggaacttcctacagacttgtcaaatggttttgactaaaatgctgatagtgatatggacaatgaagtgcaagctcaggtggtctcagatggagatgagaaacttattggaaactagagtatcttgtatgttttagcaaagagaccagtggcattttgcccccaccccagagatctgtggaactttgaagttgagagagatgatttagggtctctgagagaagaaatttttaaggattcaagaggtgatctggcttttgtgaaagtgtacagtcatatgcattcacaaagagatgatctgaaattggaacttatgtttaaaagggaagcagagcataaaagttaaaaaaaaattgcagcttggccatgtggt

SEQ ID NO: 412667 - DNA, 443 bp, Homo sapiens
tacacaaactctgggagtcaagcgtctgttgggcaggcctaggacaaagagaaccggtagtacccagaggcctaaaggtgagaagctgagggtctgcttcgtggcccagctctgccagatcagcctgcttcccaggccttatcccaccctgaaatctccgtcgcagaattcattagaggacatcagagttgttgcgtggtggttcctgtgatctctccagagcaggtgctgacaattttcccaaacccaaaagcaggtaaatgagaacaaagcactgtgtaattgtggccctttgtttttcattgaaaccagtgctgccagagacatcccacccagcagcctgctgttcatcctgcagacccaggtgttcttcattcctgcagatgcagtagttcctccatgagttaccagaaagtaaatacaaacacgacaacaacgaaaaa

SEQ ID NO: 412668 - DNA, 333 bp, Homo sapiens
atgactctgctgacactaacattaatgggattatgacatggaaaatagaaatgaagagatgatctttaacttcaaaagacagagacacactgacctacttaaccgtcaccacctcctgaattcctttccatccaaccctagatgattctgtgcctaccccttcatgccattgtcataattgtaagggctcatatacttggtcttgccctctagatgctgcgttccttgaggataaagcctctacctggtctgtagatgtatgcttattgcctgtggcacttcgtggtacatggtggcactcagtaaatgttgagtgaatgacaagctctccaa

SEQ ID NO: 412669 - DNA, 485 bp, Homo sapiens
cctttttaatgacttctgtattgagaaatcataatttaggaattgatagattatcatatattcactccatctaccaataactctgtgagagtcatttattgaccttggacttggccatgtggcttgcttaagaatggaatgtggagagatagcagtgtaccaccagtcttgcctttagaagcaccgtgtttctgttctcaggaacatctgacctctgccatgaggtcaagtagctgcctattagcatctgggtaccagactgaattcacgtattgcagaggcatctcagccagccggaggactcacagcctgaagcagagcaacccagcagacatgaagactcttgagtgagacataactacttattgttgtgtgccactgtgattttgggggttgtctgttatgcagcaatagctgacagttacatgagtgaactgtattaatatttgggaagtttattaaattactggaaataaagtttgcat

SEQ ID NO: 412670 - DNA, 378 bp, Homo sapiens
ctggggagctggagcctgcacactgggcctggccacatcactgttttcctcaccctctggttttattttgaaacatttggagcataaaagttgcaggagcacgcagtgcatactgtatcgccctggcctgggttccccggctctccttccctctctctctcctcttttttctctctccctccctctgtctctcctccacacacttctcttttgccaaaccatccaaatgcaggcagcagactccaaaaccattctgcctgcacctctgagcacacccttcccagtcatagccatgttaatgcgagtgtgcctgagaggatcgccgctggttccgtgatatcacccagcatcatccacaccacatcccagtgagcagtg

SEQ ID NO: 412671 - DNA, 234 bp, Homo sapiens
tgaagcactgggcacattgaccctgggttctttctctccctcctgttggtctctccttaagtgaattgttcctcacttccctgacctccaaatgttgcaatgccctagagatccattcttcccattgaaaactctccctgctatgtccctgaactacagcccagtctcatgactgtaaataccacttcagcgattcctaaatcattatttcaagcccagctctctcccctgaaa

SEQ ID NO: 412672 - DNA, 140 bp, Homo sapiens
tcccccaccccacaaaaaagagagtacgtgagattgaccaggaaacttgatacatatgaagagaggaaagcctaagacaaggaccctatgttttaggaacagacagagaaagaggagctgccaggtaggtaggaggagat

SEQ ID NO: 412673 - DNA, 248 bp, Homo sapiens
gggaaagtccctgctctcacagctgaacccgggcatattccccaggaaataaaacaaatagaagctgtatgttgttcatcagacttcagagcacaagtcctgtaacaatgaagacaccaagagaatgagaaaggacgcagattcacttctgtggacctcacttggtggactcattatagttgtcttccttgaaaacatccaaggagaagagcctttaagagagtgaatggaagtgcgacttgtaagag

SEQ ID NO: 412674 - DNA, 164 bp, Homo sapiens
ggaaaatgacttcttggattggcccgggatgagagctgccagggaagatgggagaagtagagaaaacagtacttatcccaggaagacttccctgctcagccctgtgggtttttgtttgtttcttacccatgatttcattagagccttatgctaacttggcgggg

SEQ ID NO: 412675 - DNA, 182 bp, Homo sapiens
tctgtgctcctccaaggaccgtttttagctgtgctgatgtttctgaggcaggtagccattcccacccgcccaggagacatttggttttttcccccactgtgtgttgatgtgatttatttcacccagtgctgagggactccggagccagcctatcagagcaagtactagctctgccgcacacc

SEQ ID NO: 412676 - DNA, 676 bp, Homo sapiens
  misc_feature (396)..(397): n is a, c, g, or t
ggaatttaatgttgtcaaagtctaggtgtcatccttaactttggaggccaagggaagatgagaaggcatcgagcatctaggattcagcccccagccccaacgcagtattggacggcgacttggttgaaaggggcagctgtaatttgcagtgtggttaagagatggggcaggatcacagtctcaggaaagggcagaagtcagaggttctgtgttcataatccagttctgcctcacgtcttgatttccttatctgtaaaggggcagggggtacacagagtcttcccctgcctggtggatctgttgtgacgaatagattcagaactggatgtgaaagtgctttgcaaaccatgcacatgaacacactcaaaagatagccttatcccctttttgtcaganngtgcaaagtactgtcccctttgaatcgcgcctattgctgacccgcaggtgtctttgttctgctttcctggagcagaggcgggggaccctgaaccaccattgctttgcctccagtttgcctctccccttcctggagacacacagtaggcccttagcctaatacaagaggcccagccctgccctgctggcccccactgctcccttcctgagccagtcaaacctctcccacaagctctcctgtttctctttccccctctgtcctttcatagcttattactcc

SEQ ID NO: 412677 - DNA, 486 bp, Homo sapiens
  misc_feature (105)..(106): n is a, c, g, or t
gtggatctgttgtgacgaatagattcagaactggatgtgaaagtgctttgcaaaccatgcacatgaacacactcaaaagatagccttatcccctttttgtcaganngtgcaaagtactgtcccctttgaatcgcgcctattgctgacccgcaggtgtctttgttctgctttcctggagcagaggcgggggaccctgaaccaccattgctttgcctccagtttgcctctccccttcctggagacacacagtaggcccttagcctaatacaagaggcccagccctgccctgctggcccccactgctcccttcctgagccagtcaaacctctcccacaagctctcctgtttctctttccccctctgtcctttcatagcttattactccaacctttgatgctgtctctccctccttcccttatcccactctgaacctcccacgtcttcctagctcctatctttcttccatgtagagacatggtaagtatt

SEQ ID NO: 412678 - DNA, 266 bp, Homo sapiens
tgctggggttataggtgggagccaccgcacctggccaagaataccttaattatttctagaggctctatctccaaatgcagtcatattcagaggtactgggggttaggacatcaacataagaatataagggaaacacaattcagcttattggactctgtcctgtggctcccaaaattcatggccttctcatgtgcagatacattcattccattccacaagccccaaaagtcttaactcattttagcatcaactcttaagtccaaact

SEQ ID NO: 412679 - DNA, 411 bp, Homo sapiens
tgcactggtgcgatctcagctcactgcaacctccacctccctgggttcaagcaattccctgcctcagcctcctgagtagctgagattacaggcgcccaccatcacggccggctaatttttgtgtttttagtagagacggggttttaccatcttggccaggctggtcttgaactcctgatctcatgatccacccgcctcggcctcccaaggtttctaacttttaatagtggcattatgaagtttgatgctattttgactctagattctttgtatgggatctgtgttttttctctggaagactttaggatcttgcctttatccctgacattctgaaatgcaaccatgttgtgccttggtgtggatatttaaaaattcatcatactcagcattcagtggaccttttcagtctgg

SEQ ID NO: 412680 - DNA, 229 bp, Homo sapiens
atgaaatatgcttattcaaaagcttcttggaaaagaaaatcagaaaaacatctgtataactttaaagtgattgcctctgagaaggaggaattgggtgcaggagtatagatatgaggcaggagacagtctttttcattgtaagacttgaaaattttgactttttaaactgtagaaatatacaatatagatacatatcaagcatctatcatttgtgttaggaacattccaa

SEQ ID NO: 412681 - DNA, 447 bp, Homo sapiens
acagggtttatccatgttggtaagactggtcttgaactctcgacctcagatgatccgctgccttggcctgggacgacgcccggctaattttgtatttttagtggagacagggtttctccatgttggtaagactggtctcgaactctcgacctcagatgatccgctgccttggcctcccaaagtgctgggattacaggtgtgagccactgtgcccagccgagacagcagccatttttataactcatgcgttgtcactgtgtccagcagaagctggacctcacaccctcccaagtcctccttcagcttttctaactcctggccctcaccaggtatgtattttttctgtgatgaaggccctgtcttctgcaagacatccacacctccagtgccagaggcacaaaaaccacatgggtttccatcctcacagtcttcagtccctgcctgtgg

SEQ ID NO: 412682 - DNA, 358 bp, Homo sapiens
atgttgtggagaattctaaggccagccagatttcaatgtcttataaacaacttggagtggggtagttaggaaggtttctggctattgaaaggaatctttaagatctttctggtcagttttccctgccacagatgccctttcaatacgtaagtttcatctcagctagtttttcttcaattgtgtttttaaccacttgttctactgtcatgttttggttttcttctataggggtttcaattctaagtttgttggatctactgtattttctaaaacttaaaaaaataaaatctttatttccattttttaaaatccctgtgtctcttattatgttttccttggggctagtctgcttcttgtg

SEQ ID NO: 412683 - DNA, 286 bp, Homo sapiens
gttttgccatattggccaagctggtcttgaactgctgtcctcaagtgatccatccacctcagcctcccaaagtgctgggattagaggtgtgagtcaccatgcccagcatcatattatttttaaataaaacaccatagaaaggaaagaagaatagaaaaataaattatctttagcccatttgtatgcagctgatgttaacatgttaatgtacttgttcttagtcttttcctatgcttagttttttaatagttaaaatcatactgcagacataattttgcattctgtt

SEQ ID NO: 412684 - DNA, 447 bp, Homo sapiens
ggagactggggtatatcctcgactctcatacctcattattgagggttgtcttgctaactgtctgctgtgcacaccctgaagccagaaaataacttaaagcagaagtgaaaggtagcccagggcatctggaaatgtctgcaggtaacctcgggtgagctgaggagtatgggtggggcacccatagtgtctccaacaaagtgtttctgactttgctttctaagatgtgcaactcataccacaaggggtcttgtgagatggctttggtgtggcacagagagagacatggtacccaagagcacaaagtctcagaatgggaaagggatttttcccttttgagctgtctctttgatcctgctctgcccgcctctcacccctggggctgccctctctccccagagcaggtgctccacccacgctggcctttcacttcctccaacttgtgggact

SEQ ID NO: 412685 - DNA, 443 bp, Homo sapiens
acttgttgctatttataaaatatgatttggttcttacaatgtaaagaaaacataatacttgaaaataattggaaaccagaaaaaattacaataagccaagattcctatttctgctctaatgctttgataatgagttaaaggcaaggaaaaataaaatcacacatggagctgaagtaatgcaacaatttcttggataatccaatctctaatattattagtatctaaaatgctaaccaggcccaacccctcctcctaaataaggcattgaaaagaaatacaacaggaagatcatactgccatcaatggtactaacattatttcttcatgtctttttctaaaaaggtaagcttgcttgaaaccatgtttcaacatcatacactagaaatccctaaaattattagaagtggtcattcgaaactctgtcacttttcacagatagccca

SEQ ID NO: 412686 - DNA, 315 bp, Homo sapiens
attggagattaaccatctaacaggttagtctttaagtcacccactataattgacaatcaaatgatagctcccttctccttcttcctctactgtgcttttccacacattctcttttgtggaaccaaccttcatttttgtggaataataaatcttttttttttttttttttgagacagagcctcactctgttgcccaggctgggatgcagtggcacgatctcagctctcagctcactgcaagctctgtctcccaagttcaagtgattctcgtgcctcagcctccctaatagctgggattacaggtgtgcgccaccat

SEQ ID NO: 412687 - DNA, 485 bp, Homo sapiens
aaactttgtaccattaaacactctctactattaactttccaagaatcatgtaggattcaaactggaaatctaaggaagcttgctttctgaagacttccacatgggctatcaccggcttctaaggtttgcctaacattgagattgtttagttcgccacatgtttattgatggtctactatgttctggcactaaaattaggcatacaatatatcgctgcaatagttgaggacattgttcctaatataaaccctaagaggggccgggcacagtgtcttacacctgtaatcccaacattttgggaggctgagttgggcagatcacttgaggccaggagttcaagaccatcgtggccaacatggtgaaaccccatctctactaaaaatacaaaaatcagccaggtgtggtggtgcacacctgtaatcccagctactcaggaaatcacttgaacccaggaggcggaggttgcagtgagcccagatcacgcc

SEQ ID NO: 412688 - DNA, 430 bp, Homo sapiens
cttcatgggcatgtgacatgtgatgtcacacagggacctgtgcatacaagggcaccatattggtgtattactcagtagctgccatcttgaaattcgtcataaaattggaacagaatcttgcattttcattttgtgcagggcctctcaaattctggaggtggtctggacacctggcttagttttctttgaaaatacttgaagttaaatcctgtagctggaagatgatggaagggaattggcaggaggctatgtgtatgggcatccccaccacgacaaaaacaagggtcattttttacctgtttagtgaaaggtctctatgcaaattgatttttcatttccttttctggtcgccatggaaattgatttttcattttcttgactgcaaggcactgatgatcgccaactctcatgttttacaaacaggtgaccc

SEQ ID NO: 412689 - DNA, 557 bp, Homo sapiens
cagcccccagcatcatctaccattcctgctcttgcccaccaactcagccatgttacctttgtgtctggagaacttcaaatgcaccagactcaccctgccttagggcctctgtgccagctgttcctgctgcctgacagattttccctcagctccttgcatgtcctctctgacactcaggtctcaattccaatgtcaccttcacagtcaggccgcttctctgatcatccattctcaaatagtttcccaggcactaacacatcgtcttggcccttcactgttgacttatttgctcacttatgtattttatgtctccctctgttgaaatgtaagctgtttgaaagcggggacctcgcgatgagcatctttcctctactgtaaccctgtaaccccagctcctagaagagtgcccggtacacagtgattgctcaatacatgtttgtagagtgttgaatgaataaacagggatgtcactctagttaaaaacaccctatttttcctactgccatggaatctagtctgatctctgagcctgacattcaggctctcgcagtctagtt

SEQ ID NO: 412690 - DNA, 711 bp, Homo sapiens
gcatgttgtacacatgtaccctagaacttaaagtacaataataataataataataataataataataaataaataaataaattgcccagtctcaggtatatctttattagcagtgtgagaatggactaatacaatatctaacaaaagctaacattatttgtagtgtttattctgtgacaagtgctgagctaagcacagacctacattatttcagctagtcatgacaattctgtgaggttattattgctattttattgatgttttttagggagttttcagtaatttgcccaaggtagtatagctagtaaatgactggagctgagattcgcatccaggtctgcctgactgtgaaccctgagctctagtcctgactctctgggaaggctcagttggctggggaggtgtgggtttggggaggaaataaaaatgtgaaaaaaaagaagttgtctatcacacacaaggcacatattaagaggaatgacttttaaagtcagagaatcagtttctctgtcaggaatttgttattaagagttacagtttaatcatctagaagagtggattgtattaaatcttttttgtgatgtgctagtaatgaaagcgttatactgggtttttcctctctgttatcaaatagcatattcctctcagcaatgaaaactgtcaccatttcttggcacatgttgaaaagattacccacatgtcacagacacc

SEQ ID NO: 412691 - DNA, 261 bp, Homo sapiens
aaaatacagctattcctatgatccccagcttctcatcattcagtgtctactaggagaagtatcacaggtcacatcacccaagagtatctggtctcctccacagttaaattctcacatcatttttggggagagttcaatttcttttttcttgagacagggtcttgctctgccacccaggctgtgtcctattctccttttcttttaggacaccagtcgtattggattgaggcccacccttatgacctcacttaacctcagtta

SEQ ID NO: 412692 - DNA, 363 bp, Homo sapiens
tgcatttggataattcctatagtatctagccataatcacgtgtttttagattgtgtgtctgcatctagtagctttctgaggactctgaagaaacagtagaaactaagaatttcaaagttcagtttgatatttggggattaaaaattaattaatagaaatacatgaggattaatagagagggctttagaatcaggcaaacctggattcagatccagctctgctgcttagtagagctgtactttagacttgttccccaccctcactgatcccttcctcatctgtaaaatggaggttaccacgccttccctccggggctgtcctgaaggtcaaatgaggatgtgtatgcagagcacctgaccttag

SEQ ID NO: 412693 - DNA, 320 bp, Homo sapiens
gaccctgttttatcacttcaaaaagaaaggtggtaaaatgattttgacagctattgaagaatctaaccatttcaaagtgcctaggacttagacatgctccttagatgaatctttatttttttcattttcgactgtaagtttagaggaaacttacctgctttacccactttatgtgatattaatcacactgtgtgcctataatggttagcatctctcatccattaatagattgtgatgacatgatcaactggagagagttctcatcaggaatttcagagagaagacagaaatacttcttttgctgtctatgtgaggtgtat

SEQ ID NO: 412694 - DNA, 132 bp, Homo sapiens
gcccaccttggcctcccaaagcgctgggattacaggcatgagccactgagcctggcccaaatgtattttttcttaagaagtaaaacatcttgagatttaacttatgccagagaagtattctgggttaaatat

SEQ ID NO: 412695 - DNA, 628 bp, Homo sapiens
gagaccttgctgggagggatagcattagaagctatacctaatataggtgacaggttgatgggtgcagcaaaccaccatggcatgtgtatacctatataacaaaactgcacgttctgcacatacaccccagaactttaatgaaaaaagaaaaagagaccttgctttcgtagttcctcaaaagttgtaagattgaccaaaaaggaatctattgatttggatagtgaggagaagcaggcaggcatgtgtgatgggaaaatagacttaagcggatcagctgatccgttaaagcaaaaaagaagttacattaagcagaacctacattgtatggcaaatgggaaccggctactaagtaaagcgtgctgtcaatatgcgtacaaaacaaaatccctacagtggtaatagcttatgaaaaggaacaaagaacaccatggttaccaaatgtatacaaaagagaagattaaggggagacaatggtgtctgggaggcaaactacagtttgcagtaagataacttgccgtgcatcttttaaatcactgcttaaaaaacaaaaaacagctgggcagttcctaactacttagaatgcaatcctaattactgcaactcttgctcaatcttgagatggaggtcg

SEQ ID NO: 412696 - DNA, 252 bp, Homo sapiens
tggtactgatgagaagtctgctgtaattcttaaacttgtttttctataggtaaagtgtttgttccttctggcttcttctaaggttttctctttgtagttggttttctgcagtttgcatatgctatgcctacaagtagtttaagtgtttatcctgcttttctctgaacctcatggatctgtggttttgtgtttgtcattactttcaagtatttcttctgctccactttttcttctttttctggtattcaaatt

SEQ ID NO: 412697 - DNA, 384 bp, Homo sapiens
ttcaatttctctacagaatcccagagggaaatgggaaaccagttcccttttagataaaatatttcaacaaagagaaaaacttcataaatacctactgataccatctggatttaaatacacttaacttcagccccctaaaattgaattgaatgaagataaaataaactgcttgctctccactcctcctgtcctcaacctttgaaacagtgtaaaggaagagctaaactaagttcccaaaatggaactccgtactgtagcaccatttcctataaaggcagcaattacaatttcatagagggcaggcggtgaatctaaattctagcttgatataacgacaagccaaggaatgtctaaagagagtacaaacaaatcctgcaactgaaa

SEQ ID NO: 412698 - DNA, 631 bp, Homo sapiens
gcgcgggcagtggtgggaaggctggcgcgaggcgtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttatctaggtat

SEQ ID NO: 412699 - DNA, 690 bp, Homo sapiens
gcgcgggcagtggtgggaaggctggcgcgaggcgtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaaca

SEQ ID NO: 412700 - DNA, 214 bp, Homo sapiens
gacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctcc

SEQ ID NO: 412701 - DNA, 361 bp, Homo sapiens
acacagcgaaacgagtacaaaaataggcttatcccaagcacattaatgaagaacatgttataagatgattttaaactaatctgcagctctatcactaagcatctagcagaacacattataagcgttctatcaggttatttctggtgtagacaaacgaaaagccagtttctattatttgactggtgcccatttgtattaaaggactaagatggaaaagaggcaaagaatttcctaattactgatgacaatgatctgctgagtcaagtcagaatgtgattcagtaagattggaggggaagggaatgcaatataatggatgggtacagtattgctggtatcttcgtggtcgctgtgttgtaaca

SEQ ID NO: 412702 - DNA, 614 bp, Homo sapiens
ctctcttatatccctctccaggtaatctctcccaacctccacctcaaacattgatcttatctttcccactatagatcagttttacagaatttgacttaatggaatcaaagacacttttgtgtcttgcttctttttatcaacataacttttctaagtattgtatcaatagtttgctccttcacactgctgagtagtattctcttgtatgaaaatacacaacttgtttattggtggacacttggattacgtaattataggcttttataaatgaagttaagacacgtataaatctttctgtggacaggtatctacatttctcttgaataaatatacaaaatgaaatcactggattaaagtatagatatgcacttaaatttttaagaaactgccaaactgtttccaccttacaatcacattttcaagatatgagagttctacttattccacatcagttcccacatttggtataatcagactttttattgcttattccagtaggtatgcactattctatctcattatggtataaatttgtatttttctgatatttaaagattttcagaggctgggcacagtggcttatgtctataatctcagcactttgggaggccaag

SEQ ID NO: 412703 - DNA, 194 bp, Homo sapiens
ttgtaggatagacaccaagaagaacttttaagtcactaaagttgtaagattacagggactacctgctaaaatcaagtgtagggtcaatgtccccttagctagcatgccttaaggaatggagggatgggaaggacctttcaaaacctgacccagcctgaagttgagtgttccattttgtagaaggttctgagagg

SEQ ID NO: 412704 - DNA, 198 bp, Homo sapiens
gtgggtgtgtctggctgctgcatggtggaggggcagtgagcgaaggggtgcccagcaggaatcactgggcaccaggcagaaacttggctggaggcaggactgagacctcagggtctgtgcccagggcagcagcagggtggacagagcccgggggtacagatgggatggctgtgaggagcaccctgtaaggagccctca

SEQ ID NO: 412705 - DNA, 376 bp, Homo sapiens
tgtctgtcaactaaacagccaatatagactgataaaatatatttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattctgagaccagcctggccagcatggtgaaacctgtctctactaaaaatacaaaaattagccaggcatggtgacgggcacctgtaataatcccagctactcaggaggctgaggtttcagtgagctgagatcatgccac

SEQ ID NO: 412706 - DNA, 602 bp, Homo sapiens
ctgtattcttccttgtttatgaaaaagagacatttttaagaaagcaaagggtatagaagagctacatttggcattcagagcaattgacacttttattacttaacgtcacaaccttatgaggtaggccagtctaagtgctgtcattttataagtgattaaaccaagactgagaataggaaatgagaaaaatcatgagctgcccagggccaaacagaaagcaaggttggggccagctgaattcagaaacctcaattaaattccaagacaaaagggaacagccaacattgaaaataagttttatggatttcactttgaaataaaacaacaacaaaaaaattatgttaccattaaatgatattaaaatcgtcttttacggggcctcgattttgccaccaaggctttattcccaaaaattaaaataaaaaaaaatcaaacaggcaaatctattccaggttaaaaattccacttacacacaaaatcttgcattccatattgagaggttttttttcttaatttgcctattaatctgtattaagccaaaggtctttgttcaagttgctcaagtgtcattgattagacccattgtggttaacaaggacatt

SEQ ID NO: 412707 - DNA, 240 bp, Homo sapiens
actttgtgtcagtataagagtcttcatacccaaggggccccatagcagaagtaagtgattagtgcaagctcttccaggaacacaaggctctttggaaaacccaatccaaggaggaataaaactagcacatatccaggcatattaaattttccttcataataagcacagataactcaaggaaccattcctccttcctttacctattcactgctccccctccaatagaataaaatttcatgt

SEQ ID NO: 412708 - DNA, 445 bp, Homo sapiens
aatgccattttgtgatgctggttttgtcagtagttggtttaattgggtactatcaggttgtcttgtcttcatttaacttccgtacatgtgctgttatccatttgtttcccaacatctgttgctctccagtgtcttcctaggtgtatgtttgattggattcatttttctttcctgtggctcatgccctcagagcatgcataatgtattgaaggattgtgtgcactagcaggaaaatgatgtggggaggactgtaggctgactgcctagctcatccgtagtgatacagcttatggcacttgataggtgatttctaaggaacactgagatcagtctctggaacgtgggatctaattccatctctttaattttaggcaagtcattgaactttctagacccagtttcttcgataaagtgcctaagatttttaatccattgtaactcctca

SEQ ID NO: 412709 - DNA, 215 bp, Homo sapiens
tgggcaacaagaattttaatttttaaaaaaattaaacgttagcctggtgtggtggttcatgcctgtcatctcggtactgtgggaggcctaggtgggaggatcacttaagcccaggagttcaagaccagcctgggcaacaaagtgagacccccccatctctacaaaaatatataaaaatcagctgggcatgctgacacacatctgtgataccaggt

SEQ ID NO: 412710 - DNA, 343 bp, Homo sapiens
ggaacagagacccaaccaattgttccagtttcaaccactggtgccccaaacaaaaacacacagccaaaaactctacccccacctgtaccaacccactgtgtgtggggggtttgctaccttcttttttttgatacatacttgctcacatctttaacctaccaaaagctaatctctttcacaccactccttccaatctttgaagggtgctatcatgctcaccaattcatcttttccatagctgaaaacttcgatagctcctcacgatattttgcctcttctaaattagctttaattttaccataaatacagtctaaaatcatgggctttttttttttttttttga

SEQ ID NO: 412711 - DNA, 517 bp, Homo sapiens
gtgacctggcattactgtctgtctagtgcctgaattctcttgcccagtggtccgctagccaggctaggtttcaccgtctctagtaaaagcattctccattaaacaaggtcatttctgatattgttatgaagaaaataaaacactgtaatatgatagagtgagtgggcagggatcagaggaaaaaggaacattattttgactattagggaaggtctcactaaggatgtgatattgcagcagtgacctgaatgacaggaagctggccatggaaaggggaggaacagcccaggcaaaggtcctgaggcagagtcatcttggcacacggaaggcacaggaagaaggcaggaccgtggtgaatgacagcagcagtcaatgaagctggagaaacaggcagggtcagtcagcacctgtgcagttgccctagttgaccaaggtcctgggaagctgctggggacagacaagatttaactcaagagtttttaaacgaccactctcgcataatcacggtcttaaaact

SEQ ID NO: 412712 - DNA, 256 bp, Homo sapiens
cggttgtgcatagctctgttacagcacttcacacacagctgttactctctccttgctttccttcttcactagacttcaaggatcttatcacgtttgcattcccagtgcttagtgcactgtagatgtaacatcaatgtcgctgaggtcacggaatgattacaaggtgtcattttcatctctctgttagtaataataccaacagctaatgtttagtgtctacattctttggaccaggcattaagctaatctcactaca

SEQ ID NO: 412713 - DNA, 293 bp, Homo sapiens
tttctcataagtagcaaaaatcataaaccactttagtgaactttctgcctagtacactgactcacagaaaagcttaggttatcctatgaatattctattcttgtaatatttagaaattcagtaaaatatcgacaatatttacataccctccccatcctccgtgtcaggatactatcctgcactctttgtccttacttatttctccttaagcgctttcggctcactgcaacctccacctcctggcttcaagcaattctccccgtctcagcctcctgcgtagctgggacgacagg

SEQ ID NO: 412714 - DNA, 366 bp, Homo sapiens
aggcaagtttgctttttattatttaatctagtttatttccaagttcttacagtcattcataatttggtgaataatatgcccaagactatgcaagaaagtcctgtaagcaatcagtggtttggctatagtaattacaagatgagggcctcagaagttcttgtttaagcttgacagtggcttgtttaaatagattaattataggagagtttttattaaccctattttattctagcttttgaaatcaagtagtatttatttgtaaatatataagataacttagaattagatacaatgctttataataggaaaacataggcaagacgttacttaaagatagctgtgatagtgatgagtggtggaagcagt

SEQ ID NO: 412715 - DNA, 349 bp, Homo sapiens
ttttttttttttttttttaatgtgtttgtgctttgtcttccatattaaagtggaaactctctgggtagaggtgacctttaaactttattgtcttgaactttttaaacttaattttatccagtgcattgcagagggtggcattcattaaattttgcagactggtagtaaaatagaggacttgagtctttagggctcagactgacattttcaatgtgtactctttggttatttagatcagtggattcaagctgtatcatgcacgatggtctttcaaggagcgttaaaaaattcaggcccccatgctctacgcatgtgattcactaggtctgaggtgagacaaagggaaaca

SEQ ID NO: 412716 - DNA, 240 bp, Homo sapiens
actcttatatgacctacataatagttttcatctttttctccttctctttcatgttaaaaggatgagaaaaattccccttcttgtctaaggagagtcataaactcccttctacctccttggagacattaagttgtcaataatcctgtcttttctctttgaaaagattcaaaagataatctctccctttttaccctttttactgactttttctttctttctttttttttttttttttttttt

SEQ ID NO: 412717 - DNA, 306 bp, Homo sapiens
ttctctacctcctaccatttcaaaggtgctgtcatttaccagtatctttctcaaaggaaccatcattatttgttgctcactttagtaccacaattcctgtaggtggtttccagcagtctcctcattctattccttgacgagtctaccttttgctgctgctctcacactgcttcccagtgaggaaaaaaataggctttaagagtcatcagtatacggagtgctactttatgcatacaaaactgacgacaaggacttaagcgcaactttcacatgttaagttgtttttttcttttctttttttttttt

SEQ ID NO: 412718 - DNA, 599 bp, Homo sapiens
tcctccatgaattctaagtcatgaattctaaactgaccgataacaggatttgcgtgttaacattaatctcatatttacataatacttttcattttccaaataacgttcctaataatctgatttgatcatcaagagatctttggaagcatgttaatttgtatcctttatatccgtgtgatactttttggtttgcaagtaatgcttacgtggcttggcagggcgtagtggctcatgcctgtaatcctagcactttgggagttcgaggcggggggatcacttgaactcgggttcgagaccaccctggggaacatggcgaaaccccgtcttgacaaaaaaataaaaaaactagctgggcgtggtggcatatgcctgtcattctagttactttggggggctgaggtggaggaatcacttgaacctgggaggcagaggttgctgtgagcacagatcacgccactgcactctagcctgggcgacagattgagaccctgtctcaaaacaaaactaacttgaaccacgtgaggctcttggaagcccacaaattggtgttgagtgaattcctatccagattaaactgtagcctaaagtcgctcagctaa

SEQ ID NO: 412719 - DNA, 535 bp, Homo sapiens
tccaaactcaagctaactgtcctgcctcagcctcccagagtgctggaattacaggcataagcactgcattggccaataagaggatttttaatggctatacaatattcttctgcgtacgtacaccacagagtatttgttctatctcccaagcttaccacttaggaggtttcccccttttggctatcataaatcatgccacgatgcattgccttccacgttctctctgcacatctttgaccatgtgtgtaaaaggtcccgtttgtctccttttgcctcgtcttaaccttgttgctgaacgtgagtgtaaaacctgctggagagctcaagtacatggtgccggggagggcaggcaatctcgcggtccttctgcggctacgaggttggttggtttgtttttttatgagcacattcttggtgaaccataagatgtatgcagttcccctccatgcctgggtgtagcctgagcctcagcctcaggtccagacaatgacagcattcagatgtgtgcatgaatgagctcggagtgtgaagcaga

SEQ ID NO: 412720 - DNA, 661 bp, Homo sapiens
acacacaaaagacgggaagctactttggaagacagtttggcagtttcctcaaaagttaaacttgtcatatgaccactcttaggtatatactcaagcgaattgaaaacttgtgtccacacaaagacttggctgcaaatgttcatggcaacattaattcataatagccaacaactggaagtgatccacaagtccatcagctggtgcatggatacacaaaatgtgtaatatccatacaatagacatatctttttatttggcaataaaaggcactgggagcgtgccacagtggcttgagcctgcactcccaggacacagaaggctgaggcaggaggattgcttgagtccaggagttggaggctgccatgagccttgatagtgctactgtactccagcctgggtgacagagcaagactccagctctaaataaataaattaagcaatgaaacactggtaaatgctacaagctggatgaatctccaaagcataatgctaagtgaaagaagccagatgtgtacaactacatattgtatgattctgtttatatgaaatctgcagaaaaggcaaatttatggaggcaaaaagcagatcagtggtttcccagacctgggggtggtagaagaaacagagatgacctgtaaattaggttgggggacatttttga

SEQ ID NO: 412721 - DNA, 1279 bp, Homo sapiens
  misc_feature (1113)..(1113): n is a, c, g, or t
ctcactgcaacctccacctccctggttcaggcgattctcctgcctcagcctcccaaagtgctgggattacaggcatgcaacaccacacccagcctgaaacccagatttttaatatgaaatcaaagtcttcagaccttgtaggtgtcataaaaagcacgctgaggaccactagtttgcaactgccaatctaaaatatcatagacattatatcacttcaaccacgaaaaaaaaagtatgtgaggcagaaaatggaagcaaccatgcctaatttattgttgaatactttttccgtataccaagagcttcctttgcactagcatctgaaactatatccagaatgacactggttttcataaaagtgttgatcctcacacctctttatagtcttgcacctagcacagtggagtgaaacactttaaatagcacttgttccttgagtatatatggaaaaaagtgaagtattgataagtgctcagctaatatgagcagcatctcaggagtctccaattcttgaattaccagggagtatttttaccattttcccccagtgaaaggcctattttgagagacttaccctccaaaatgaatgtattaagtcatgttcctttttttttttttttttggaaaaggggcctgggccttgtgtggcccaggtggggtgcgaccttgatgtccgggaaggggtgtccccattttagaacccaaaagaagaggtgttctggcgtctctggttgcacaagaacagactcccggttgctcgccccggtgtgcacgtgaacgcaggttctattcacgacaacgttaacggaggagggacacgggtgccccactctggtgatccccagcgcttggggaagcgccgacaaagcctgctaccacgaaggtcaggagatcagcaccttcgtgtttaccccgtgtggaaagactcatcttttaaccaaaaaaaaaaacaaaaacaacaaacaaaattgttggcgggcacccgcacacggaaagatttaaacacacgtgctgggcgccgcggaccccgaaaggataggcagacatcggcgaaggtgcgcaaagagacacccgccggaacaaggtgcggttgccacccaaaaaaaccgcgcnaccgggtttggcacacaccagaggcttcgggcctcgggtccacaggtccggactaatctcccctcgtccgcggtgcgtaccgacaggcacagagaacaaagatgacaaagtccacgaagacacagagacacacgagcgacgcacaacacgaacacgagcaatagat

SEQ ID NO: 412722 - DNA, 501 bp, Homo sapiens
cagtgaaagggctcatgaatgctcaacatggtgactgaaaaaaaagaaccacatcaagatacatcatggtgaaatttcagacaccagaaataaagggaagatcaagaaagctttcaggaatggagcacaaagaagggattagaaataggtagcattggaaagtaatcagtaatggaataatacattcaaaatcctgaaggaaagttatttccaaactattcattctataccttaccaagctatcaagtgtgggaggaggctaaaaatatgaaacatgaggttgttagaatatttacttcaaaagtactatatcaggaacttactagaaggcacaggctccatcaaagtgatgggttaactaaaaagaggggggatccagaaagtaggatgcattacaggagaagagtgaagagaatttctaggatgattatgaagggagattcaaggatagggctgtacaggaggtctgaagagtaatcagttcagcttgggataggaggt

SEQ ID NO: 412723 - DNA, 333 bp, Homo sapiens
cagaaattgtcaataatgggcccaaagagaatagctgcaggtgacagagctcagaatccaactcaggcagttcatctcagaacctgctttcttcacccctgtgtggatctctaaattagaaacagtaaccaggacagggaagggattctgtcagtagatataagtcaagggcaagggtcattttggaagtgggaagcagaggtgagtataattggggtggatgttagaggaagaagctatgggaggtctattattgtcagacctgaatgaagaagagcccatcagcaactctctagttaattcaaaaagacttttagggaagacggcaagcgg

SEQ ID NO: 412724 - DNA, 1185 bp, Homo sapiens
gtcttgtaaaactaaacatataccattctattcttgggcatttatcccaaagaaatgaaaaattaaactcatccaaaaccctgtctatgattgctcacagcagctttactcacaatggcaaaatagtgaaaatctgaatgtccttcaatgagtaaatgtttgaacaaacgctggtacaaccacacaatggaacactcaacaatttaaaaaatgaactactgatacaacaatttagatggacctcaagggaattatgctttgcgaaaaaagtcaatctcaaatggttacatattatactattccatttatataacatgctcaaatgtcaaaactatagagatggagaacggataagtggaacaggaacagtggtgggtgtggtggtgggcatgtgtgtgtggggggtgcagatacaaagaacagggagttcctttatggtaacagttctaagtcttgattgtggtggtggttacaggaacatatatatggcacgaaattgcacacacttatgcacaaatgaatagatttttaaaatggtgaaaactaagttttgtaatttatttaaaagtaatgtaccaatataaatttcctggttttgatactgaagtacagctatgtaagatattgccattgaaggaagctgagtgagaagcccacaggactctgtaccatttcttgcaacttcctgaatctataattatctcaaaataaaaaggatcagaatacattcatgagcaaaaaagagcaaattacagaataaaacaaaaacttgaaaacctacatgtaattttctttttgactgctcttgcggaacagggctaccctataggcagtgtgctgagagcagcgtaataagtaaacacgttttgtctaagcatagaaaaaagtacctaagactatagaccaagctgttatctctggggaaatgaaaatatgggagacaggagtgggagggcaggcagaggctttaacttttaattttatgtatttctagattatttgatctttttataagagattttgcttttttgttttttaaaaggtctacctgacagaaatgtagatgataggttagaaggagataaatgtaaaggctgggacattcaccaggcgactaggcaaaatgtaatgtgaactttagtgacatactggatgttggaacttattcaaagtgaagaattaaaa

SEQ ID NO: 412725 - DNA, 674 bp, Homo sapiens
tgccgtcttgtgatcagccagggtggggaatgaaaatgggtccaacaacattaagccacagcacaatcctccctgatgttgagaaatctggctgtggacatggagaatgtgtttgtgggtacatttttgcctctcgaatgaaccgaatttgccattggcatttactgccagactgtcgggaattatgtggggttgtggggggattatgtggggtgaagttgaacaattctcaactttggaattgggcagacctgagtttgaatccagatcatttgctgttagcattgtgaccctgggctattgattcaactgtctcctgagcctggtttctcatccgttaagtgggcatacaatttcatttacaatggggttgtaagaatgaaaagatacacatttgcccagggtctggcacatgggtatttaatgatagtctcccctgcctgcattccctttctgctccccattccccccaacatcccgtgtttctgaacccccaaattgctgactttcaccaggttcactccctctgataaactccctcccttaatctgcacaaagccctctctgtgtgccaaatggacggtttttggaccagtttcttagttgctcccagcctctgcccccacccctccacagctatccctctgacaaatccggaaccatggaagtcctca

SEQ ID NO: 412726 - DNA, 376 bp, Homo sapiens
cagatcctgtaacatgttagatgtagctaccttcaaattcctgccttcaaagccctcacttgatagttaacagcatcccagccatacacatcttctcttcttgagaaggtgactcctctgatcatagaatcatgctcatctgttttctgacttttcagaccatgcatggctttcccctccctggctctatgcctgggttgtttttgaaggggttttctcctttccactgtatgcctctgcagttagtcaaggccagagtagacccttctcccatgtcatcttccacatttgttttggttcctcatctgaggctgtgggccatgcaagcagagctatggccagtccccgaatatggcttgaagcaatgctcaaaaaa

SEQ ID NO: 412727 - DNA, 185 bp, Homo sapiens
cactgcacctggccgacatctttttgtatcacctactttatccagttgttatagttacatgacaatgctttatgttaaatgataatagtgcctggcatatgataaatactatataaatgttagctactgttgcatgttttttataattgttataataattattataatagtgtaggtgctaaaat

SEQ ID NO: 412728 - DNA, 663 bp, Homo sapiens
tggggtggggacacataggacacactctaggcactgaataaatgaattgaaatagagaacgtaagctgtctgtgaccagattaaggatatagtactctggaataaggttctagaagccacaatggcagtacagagtacattttactaaatttgattctgtttcagtggttggcttatttgctgctttttttagctttatctgttttctctgagcctcagtttcctcctgttagattaagatactaatgcctatttaacagggttatggtaaccattaagtgagtttagtatggaaagcacatcatacagcacctaccacatagttggtgctctgtaagtgataggctgaaatggccatcttcatttttttccttctgaaaaaaaccctatgtcttacctggactattgcagctgacacctgacagtcttgcttttgtccctcctccctctcttttcttctctgcacttatgttgaataattcttctaaaatattgatcatgtaatcttccctttttgtatttctataacgtctgctcattgcttgcatgatcaagttcaaactccttggcttggaattcaaagcacttcagggtccagtaccttggttctttcctaatccctactgtcctgtgctgccatttctctcctgcctttcctgttat

SEQ ID NO: 412729 - DNA, 711 bp, Homo sapiens
agtagctcttttttttattctaagttaaagaaaaggtgaatttttctaaatagcaatatagaaataataatatatttgggattctttactgcatctaattttgaattacccatacctgcatgtttggtggagctggaactattcagatttctattcattgggatacatttaacccatattacatgcttatagagcaaagacatcaaacaaactgttttagaatatgagatgttaaagaaaaacatgatctcaaatcctaggcaaacgcagtgcagcatatgaatgtgttgggtagtagctttcatgtatagcagaatagcgttaggcatgttgcaaagttctagtatcaatttccaacaatttcctttttatcaattcctgtgatcatctctgagaagcctctaacataatgtgtcttctgctaacactactggcacagcattatccacagactttttacatgctaatcctagccacagacctttggtgattctttcccttatcatccactccctgggctctttggtgtgggattgaagaagagaagcctcagagaagcattgcttctgaggaagaactagatacgtggcgaaggtgtagtatgtttgagagacaatacagtgaaaggaacgaatgaaacaagaggtgaaaattaaggaacttgagaaaatgaaagcaaaacaagacacctgactggtcttctgctcactg

SEQ ID NO: 412730 - DNA, 325 bp, Homo sapiens
ttattaataagtgttaaacatgtacatatattcttatagaacagaaggcaactggacagttggctgagggaatcaatatcttagcacatcttagcaatttattcacagttgggaattgctactttaatatacatacgcctaacagttttccatgtactttttcatttaaatatttcctgagcatttactatgagccaggccttaatggcatggcagggcacaagataagtaaggtctttgccccaggaagcttacattctagtgggagagacaataagaaagaaatatatgaatatttgtcagggaatcttaagtgccacaaata

SEQ ID NO: 412731 - DNA, 426 bp, Homo sapiens
tcataacagctaaaaagaagctcccagatgtgcctctgcagtcagagtggtgcagtgttctatgtccatgccacaagatgctgtgcagccctgggtgtgtgtgagccacagccacgagcagctacaaggaagattctcctgataatgaaggcacagaatcacatggacaggctggagagcaggcagagctccactgtgttttccagggggtgtgtatgtgtgtgcatgcgtgtgtgtgcatgtgtgagcgtgtgtgtgtgtgtgtgtctggggctaaaaggcagtggttcattgggcacgttgggtgctcctggcagacccgtgactttctcttctggacccgagtggtggttacctcgattttgctttataattatttgtcaagctctatgtacgttttatgcagtttctctctctgtgtgtgcg

SEQ ID NO: 412732 - DNA, 521 bp, Homo sapiens
tactggcctgggatcacacttagagaaccactgctctagaacaaaacaaattcaagttatttttgagatgaagaggggacgaatttgaaggacagaaagtctcagatgaggcaggtccagagggaataagaaggtgcagctgaagggagttaatctttgcaaggagaagtgcttccctcttacagaagagagaaagaaaagagttgataagacgctaaaaggttttgaggtgaaagagaggcatatttaagggagtcacctaagttggactttgagacacagctttaaatcaaatagatctgtgtccaaatcctggttcagcagtcacactcacattccaagttgtataacttctccaagccttagtgcctttatcttgaaattcaggataaccgaacagcacttagcctgtaggttgttgtgaagattgagtgatgagctagtactgcttcctgttagtgagcagagagagcgagcctgggaaacaaaaagacaaagaacagagtgaccttgactgtagc

SEQ ID NO: 412733 - DNA, 493 bp, Homo sapiens
tgttagaaagaagcctgctgcaggtgctctaaataccatccccactgaaggaaggagcaccatttaagaggctggggaaggaggggtgacgaggcctggctttgcaacgggacagccctgggataagatgctgcctcacagcctgagacccgggacaggtgcgcaggcttctctgagccccagctccctcctccgcagcgtgggataacagtacttgtgtccacaacacatgtgaacacaccagcacggtgtctggcaagtggaaggcgtgcaatgatgtcactttagaggcagcttgtaaagaatgacagcttctgatgggtttctgtgacaacctgttctctagccgggtgtcaggaactttcagcaactatcaacagctctatgaactgctcggcaaggaaggttataaatacccaccctcccccagtacaggaggggcagtaatgcccacactctgaaagctaagtttgccagaaacactaaggcatcc

SEQ ID NO: 412734 - DNA, 432 bp, Homo sapiens
ccaggaggttgaggctgcagtgagctaggatcacaccactgcactccagtctggatgacagagaaagaccctgtctcaaaaaaacaaaaaaaaagttttcactcagtgtctccctgaaaagtcattgggaacccctgggggtctacatttcaagaaccattcctctggatcggggtttctcagtcttggccttgttcccgtgtggctggccgtcctgtgcacgggaggattttagcagtatccccatagcctttacccactagatgccagaattccaccccccacctggtagttgtggcaaccaaaaatatctccagatacttccaaatgcctcccctactcccacccccaacagggacaaaaccgtctctggttgggaactactgctgtgagatcttaggtgacaactaagtttcatcttgttggggctga

SEQ ID NO: 412735 - DNA, 428 bp, Homo sapiens
catcttgaaaccaagtagggaaagggatgagggtcatgttaattttcacttgaatcttgttttcattatgatgcttcattcccatgagcatctgtgcctggtgcaacaagttctgattatttttggttgaacctttctagagaatcagtccctggttttctgcctcattaagggagtcattctaggtgggtctgattatttcttaaaatgagttgcaaacagttttcctatttcaaaccttaccttattctttgccttcagagatacttgtgcctcaaattcttgagttctggaattctatagtgagagatagatgtagcttgtatttagagaagagtatgtatcaaattgagagaaatcctacaacagacttctggtgatcgttaacggctttcacttcctaaataaagacattcctaactcttggc

SEQ ID NO: 412736 - DNA, 372 bp, Homo sapiens
tgcaagcaagatgttcttaaggtaaactgtacacttgtttttacacgtcgagtgtcaccgtgtcagttgttgacgtgtctggcatatagccttctgtaactgcttgggtgaatgggtggatagagggataaataaccaataaaacacacccctgtcctcaagaaggccacaggtgagtgccctagcacctcgcctcaccatagccactgtacctgctcagtcaagggacagagccaggctctgggcaagccaggggtaagagacagctcttggtgctcagagacacaaggacagctgggattgctgcagggagctgcttgtgccaacatgggcgtcgccagtggtgggtgtgaatgggtgtggctggtggca

SEQ ID NO: 412737 - DNA, 643 bp, Homo sapiens
ctcagtgcaacaataccccagactcctctttataaggcaatacagtataatgaaattttaaaaggcaaaaataaaagtaatccttaactaaaatggacaaaatgtacaaactccaagtagaacaggcatcaggtaagtcctttccaactttgccttcctctcacctttcattcgctcactgaacaattactgagtgcctactgaatgccaggtacgacactaggcatggtacatataaataagaagcaaacaatgcagtctagtgacttcctggggtaagaaatcaaagtggccaattccatggcactatatgaagtcagactcgtctcaacagagttttgtgtcttaaaacaagaaagcccaaagctttgaaataaattaataggtgatggaatttcaggtatcaattaaattactattacttgactgcaggcagccttgtccttggaaaaagaccatgtgatgccgcctgtgaaggcacaggtataaagaggcctcttaagacaggcctgtagcgatggagctaaagggctttagccggggtgccgctgagtgtaggcagagggcgggtcctggcaagccaaattcaccgccactgccaggacgaactattcagattcacgtggagcaaggggctaacgca

SEQ ID NO: 412738 - DNA, 1325 bp, Homo sapiens
agccatgctgtaaaaccagctcattcaatcttcattctaccctcctgatccttgccccaagaatatctgcttgcactgcagaagctaaaaagctaaaatcaacattgtccagttgttctcaccaccaggcttctggatacaatttctgatctatcaataaaatactttcatgggatttggaaactgaaagtgaagtggagatctcttattaccactttacatttcctattggcaaagtaagtcaagaaataaggtttttttccaaattgatgctccagtgtccattctccaactgtttggatgtttacaggcaaccgcactggaaacaacagctggactccaagttcaatgcccagtcaccaggtttgtgggtgtcaagaggcagttgaggcagcaacaatggcagcagctttctaagccatggcctgaaacccttgcataacgttcttaaactcagtaattcctgtggcaccatcagtggttatagcttccccagcagatcagtttttgagttctggaacttatttgtggagagtaaatttatatttaagatagttagaatggtttctatctcctggtccttgaatcatatacaccaaacaagttaacaccttacaggggaagcagcacaccaagaaggaaagaaaatgagtaatatcagtgcaagaggctaacaaactggtaagtgccagttagaccttagatacatgagaaaaacaatgaattagactagaatcagtatcctaaaattccctttgactacaaaaagttttaagtccctgaatccacaagttgtcacacataagaaatcatcatttgtccaacatgcatgtaattgcaagttttatctcaattgattatctttttttcttgaatattggccatgttttcatggttcttcctaagtatggtaattttagattacattttatatgtggtaaatgataccttacagaaactctagattctgctatagtcctttaaaaaatgttttgattttcaagggcagaaaaaataaaaagataaagaagtagaaaagaaaaaacaaacaaaaaatgtttacagtaggccaggcacagtggctcacgcctgtaatcccagcacttttggaggcagaaggtggtggatcgcttgagcccgggaattcgacacaggtctgggcaacatggtgaaaccccatctctacaaaaaatacgaaaaattagccaggtgtggtggtgcatgcctgtagtcccagctacttgggaggctgaggcaggagaattgcttgaaccctggatggggtggttgcagggaaccagtcagcattaaccacgggtaccgag

SEQ ID NO: 412739 - DNA, 582 bp, Homo sapiens
tgagccaccgcgcccggcacacaactcttgtttctgtaatatattattgtatataggacgtgtcagatacttatttatacaaattgatgtgttaatactagcggaggccatacagtaggattagggggcttaaatctgggtctttgtcttggtctaaaacaaatttgttgtgagcttggacaggttatggaaccttttttggcctgaaaataattttgtaatcaagttgaattgcctatgtgatttgtatctgtctttagattaataattgagattttaaaatgggatgtttaggactaggcatatttatttgttaggaaagagacaaccaaaagcttacatttagataaattccacttttttagccctgactagttccaaggtttaaaacaaacctcagtgactacgaatctattgtcaggggagaagatcttctcccctgacacaagagcagagctctgggtggccatccagccccaccctctgcagcagctgccctgcctgaccccgcgttcacctcaagggcacagagagcagagcctacaatgactggggtctcctcccctttatagccaaactcgg

SEQ ID NO: 412740 - DNA, 528 bp, Homo sapiens
gcaagttaacaatgagcaaaattcagtaaactagttacctctggaggcagagacagagggatgggatagggaggaagtatactagtagatacaaccatattggcaatgttttagttcttaagttgggtagtggattcataggcatttattattaccaggcttcatagcttacagatatagtatatgtattcttttgcatttttcagaattttaaaggcagctaaaggatgttgtctaaatagaatttataaaagagaggagtagaagacagtatgtcatgcatgatttgtttgtatatgtcttacatccttaactaaaagtgtaaattgagcataaagaccgtatttaatgcttctattttattatctatattatagattctataagacctactataattccgtctacaaaataaggactcagtctgtgtttattgattacatgatttgaaatagctataaaacagtaagtttaaacactattttcagaaaaattcaaattgatctgttggggagtttttctcacata

SEQ ID NO: 412741 - DNA, 2107 bp, Homo sapiens
  misc_feature (2)..(2): n is a, c, g, or t
  misc_feature (4)..(4): n is a, c, g, or t
  misc_feature (289)..(289): n is a, c, g, or t
  misc_feature (754)..(754): n is a, c, g, or t
  misc_feature (1910)..(1910): n is a, c, g, or t
  misc_feature (1918)..(1918): n is a, c, g, or t
gnantatagctgttattgctttggacactgggtgttttttttatctgacctgcattgcatatggctaatgagaagtactaaggcttgcatatcctcacctgaagtcttgagtaatgtttgattccttttgcttagcacaggttgtaaaaccttctagtgttttagtgttgtgttttaatctccacattcatggtagcttgctgaatacttggcagaaacagcttccagtgtcacgtaatctttctctgtggcagttagcatcgtctcagactcctttttcagagctctntcctcctttgtattggcaccactcttcaaattctgtgacttctcagaccttccagtcctctagtatggtccacccctcaaacttctgactcttcagcttcctcagctgaaaatgaagataaaacccacttgaaagggttgttattaggataaaattctctctctaatgcctaagccactgaggaaccctgtaaccatagatcctgactcatttatgccagagtgaggtgtggtatgaaaacaaacaaaactttatgagtagttccttccccatttgagcagcagtgacgggtgaatgtaatgcaagcggcgcattgcaggcattcagacagctcccccctccatttcctgtctgtggctactgttctctagactcttctctcacaccaccaagaatcatttattacaggtatttatattgaccatttcctccctaaggacagtgatgttgtctaactcatctttnttctcatatggtctggtaaaatgcttggcatatagtagggcagttaacaaatttgttaagtgaacaaatgtctactatatgccttgcttttgttcacagaacaccagtgtatgcagtatttggcctgccaaagtaagatgttaaatccaaagtaagatgttaaatcctaatttagcgtttagctatctgaaacacgtttaaaagttacttctttgttttaacatcatatttcgagaaattctaacatatataaaagtagacagaacagtgaaacgagccctcttaaacctgtatccattctccagattcagcaaacacattttcccacttgtgttccacctctcaatctaacctcactcccctgctcttaagcccaagtattttaaagcaatggaagacatcatgtcattttacctctaacattcttcagtatagatcctttaaaatgagaacattttgaatatgaccacaatgctgttaacattcctaattaacagtgattgcttagtagcatctgtaacccagttcataatcatatttcctcagtggtccctaaagtgtctttttaagttgatttgtagattcaaaactcaaaacaagatcaacatagcacatttagtttttttaaaaaagctttccttaaaaaaataaaaacaatacctattttaaaaattatttctctccctttctcttcttcttttcttttcgataactcttcagattagggttctttataatgaaaccataaactttgctctagcagataaaggtttcatcttttaagactgctttgctgttcttttttttttttttgatagccaagcacttaacatgtatagagagcactactgcagttaacagcacagcaaaatgcaaaactgttaactgctctgatttttcttgtgcaatgagatagcattatgtgcagtaccattaggaaaataattttacatcattttcattcataattaacattatttacattaaatgtagtctaaacctgtaaaataatcttgtattcattaaaaagtatatattctttggtatgtttagtttaaatacatctttaaaaaattttagttattcctcttgaatttatggttagggtctcaagaaggaagcttgagactagactgtaatgtgtgtttgaaaaagnctgctcanggatgaacttaattcttaaattctctaaagctcaagtggagaaatgacatctgcaaaaaatttatcttttagttgcattatgggtaataaagacaaacatgtgtaactgtttagtgtatttaaaagaaaaggagagataacccaagtgattagaggttttagtagaatagttttgagaattagaatttt

SEQ ID NO: 412742 - DNA, 518 bp, Homo sapiens
atttccttctctgtaaaacagggatgatgaaaataccagcctcatgaggttgtaatgaaggttaagtgagttcagatctctgtcaagcgcttagaacagcatctggcaggaaatgaatgctacttaagtattagttgttattgtcctttgggtctcaactgtacagtcttctctttcagggaagccatccctgtctactctgttcaggacaggcagtccctctccaacttcctggcttggttattttccaacacaggagcctgtgtgtgtccttcagagcaactcacatcttatcagcatctctttatttttcatctgtctctctcactagcctgtaaactccctgagggcaaccacttgggctgtttttgctcaagtggtactcccagcatgcagccagtgcgaggcctgccatatagtaggggtgagtagagagttgttggatgaatggatgagctaaaattaaataaatgtttaatggatttgtgcactacttcattagaataccagctacagga

SEQ ID NO: 412743 - DNA, 633 bp, Homo sapiens
aaatacatacatacatacatgtatagatatagtttacttactcttatgttcagtgttacactgttgcttatgggtataatgagcacacttcccagaatatccaggacaagtatgatttcaagtattacttaatatagttggtctctgttaattatgtgtcttaatttgggatttggaaaatatggacggtattatctgtgggaaatataaagaggtataaaaccattgcccacaagtttacaatttgactggacaaataaaatattccttaagacagtgaacgtgtaaaatttttttcatgtgttatatctattgcacagtgttccattgtatgattaaccatcacttattttatctatcctagtgatgaacacctagagtattcttcatttttaagaaacccaacttccaggataatgtttttcgtcctcctttttttttttgtttgtttgttggttttttttttttctggaagcgaaaaggagggaaagggattgtagcagagggaaaacctaagttacatgtttaaaaaaataagaaattttacaattatggggaaagaggcatggcattgtggacatgaaataattaatgtaaccatagtaacattcagagatgaagagtttctgacga

SEQ ID NO: 412744 - DNA, 506 bp, Homo sapiens
ttgagacctccgggatgtgtctaacttatctctcctgcttcacctcgcactactccaagagcaacctgtgctccagccacacagatgtgtctgcagttcccttaacagattacatcactacatacctcagtgcctttgcacagtcagtaacatgtctcacggtgctatatcttcttcaagacgcaaccaaatatctgtctcattctaaaaaattctttggtcccataagaaataattacacagacccttagacctaaacaagaaggagaccggggctaaaccctgcacttcagaggacctcacacatcataaacaaacaaaaataaatttcttgaggaacatataaacataactgtctttttggagctgatgctcagactggcacagcagaaccccaaaccctaaatatctgttgtcatgactaaaatgattcagggcccaaggaaatacctctctccaagtctttagtcctatgtccttggaaacaaaagtccactgtgtctgaa

SEQ ID NO: 412745 - DNA, 508 bp, Homo sapiens
tgaaatgtgacataaaaggatgggtttcatggagattttaccttttcctcaaatatcaaatcttttaatgttcaacttgacttttatgtgttcttgagctttttggatatttaatttactaaatgatttgcttttgaatacagtcagctctcagcaaaccaacttctgaatgaaggccagatatgccctctctcaccatggtctttttgtatttgtcctttaggaaaggaaaactgattataatgtctgtccaggcaaataacctgaatgtgaatctgatacacagcagaaagaaggaaaggctaaacatataaagcatttcaaaataaaattatttgtggattgcccattgtcctgtgtcatgagaatgactgactgaaagttggctgtatttagagactacaattaaatactatactttgtactgacttcctttaaagtttaaaagtttaaatgacctcctttaaatgtttaaagagagcccagaaaagtaataataataaagtga

SEQ ID NO: 412746 - DNA, 1044 bp, Homo sapiens
tgcccacatccaagatggcgtccccaggagctgggagcgggtgaccggcggcggggaagcggcctgggttggccctcagattgcggggtctgggggcatctcgccgggcaaacccttggcccgcctacaaggacttcccccggccagagcaatggccgctgagaacagcaagcagttttggaagaggagcgctaagctgccggggagcattcagcctgtatatggagcacagcatcctcctcttgacccacggctcaccaaaaatttcattaaagaacgatcaaaagtcaacacagttcctctgaagaataagaaggcctccagttttcatgagtttgcacggaataccagtgatgcttgggacattggcgatgatgaggaagaggacttttcctcaccttctttccaaactctgaactcaaaagttgctttggcaactgcagcccaagttctagaaaaccacagcaagctgagagtaaaaccagaacggtcccagtcaacgacatcggacgtccctgccaactacaaggtcataaagtccagcagtgatgcccagctgtccagaaactctagtgatacatgcctgaggaacccactccacaaacagcaatcactccctctccggcccatcatccccctcgttgcccggatctcggatcagaacgcttctggggcccccccaatgactgtccgggagaaaacccgcctagaaaaattccgtcagcttctctccagccagaacactgacttagatgaactgaggaagtgtagctggccaggggttcccagggaggttcgacctataacctggagactcctgtcgggctatctcccagcaaacactgagaggaggaagttgaccctgcagcggaagcgggaggaatattttggcttcattgaacagtattatgactctcgaaatgaggaacatcaccaggatacctacagacagattcacattgacattccaaggacgaatcctctcattgccgttgttcacagcaaccaattgtacaggagatctttgaaagaattctattatat

SEQ ID NO: 412747 - DNA, 211 bp, Homo sapiens
tcaaaagactgtaggaagaatgccatcaaatatttattgttcatcccattctgaatgatcttaataagacttgagccagatcctgggataatgcttttcagaggaagtatagcaacacgtgtaacaaagagtgcttaatatgcatcttataatttggataagatgtaaataattaaaagctgattctactctgtgctgatgaagactctcg

SEQ ID NO: 412748 - DNA, 291 bp, Homo sapiens
atcagtggacacagagaaagatgcgtgcttgctagagtctaaggagaaaatgttttgcagagaatgatggccaaagtgtcagagatcgcagtgacactcactcatcagcttccccccacaccctctccaaccatttccagttggtcttccagcaagaccattttaattatgtagccatgcacttgcttctgggtgtggtttccctgattgcatacttaagtgcagattacaaatatttggcaggattccttcctctgtgggaaccagacaagtcataacaccaactgaacg

SEQ ID NO: 412749 - DNA, 309 bp, Homo sapiens
caggggcaaagggaggcatgccatctttctttctcccaagaaacagctccaggatgtgggtgatgtacaaagaaattctagaatcagctcatgtctacagatgctttggaaatccattgtgtccagtgaggtactgtaaggtgatgagtggaaacaagaatgaaaaaggtgcttgctgattccaaaaaccttacacacagacacacacactgatatcaggcggatttgggtaaggctcatatgaagttaatcaacaaatcaagggaaaagggacatggaatttggaaaatgactaagaaatgttggaag

SEQ ID NO: 412750 - DNA, 1078 bp, Homo sapiens
ccctgacaacatttaaaagcaagcctcagaaagatcgaactgattccaaataacttcattgcacataaagtccaacgctattcaaaggagtacaacaaaagccagaaatcaacaatgaattttcacgatgtctggcatttggtcaaaaataagaagatatgcaaaaaattaagatccataattggaggtgggggtgggaatcaatcataagtgacagatgatggaattcacagacaaggatgctaaacagctattaaaaatgttttccatgtgttcaagaaggaggaagaaaacatggtcatgtaaggagagaaattaagcatataaaaggtcacaagcgaagcttttagagatagaaatttaatacctgaaatgaaaaatacactggatgggattcacagaatagaggaaaagatcattgagtctgaagctagagaaactatagctatagctatagaaactgttcgaatcaaagcagagaaaaaagtcttaaaaaacaaaaacaaaaacaggatactggtgacctgtgggataatatcaaagcatcgtgtctgtgtgtaagtggagatctagaaagagaagagaggcagggacagaaaaatgttttgaagaaataatggccaaacgttttttgaatttgttggaaagtataaacccacagatctaagaagcttgatagatcccatgtagaataaataccaaaagagccacatcaaggcatgttataaacaaatttctgaaagccagtgataaagagaaatcttagaagcagccagataagaaaaaacatattatgtatagaggaagaaaatatgagagacagcagatctcttgacagaaaccatgcaagctagaaggacatgggaagacatctgtaatatgctaaggaggcagtaggtggggagaacctgccaagaatgatttttttaactcagtaaaaatatcattcaaaattggagataatgactattttatacaaataaaaactgatggaattcattgtcagcaaatctgttctacaagaaatgttaaaggcttccttcaacatttctttatttttcttctttcagcagaagaa

SEQ ID NO: 412751 - DNA, 316 bp, Homo sapiens
taaatcaaacaaattcagtttcatcattgcatcagccacatttcaagtacatgtgtggctaatggttactagatgggacagtgcagaagtaaaacatttacattactttagaaagttctgttggcagtgccaatctgtaggctcctcttccatatttcttttacctttggttttcagcagtttggctattatgcatgtagttgtttttcttgtatttctctggcttggagctcactgagcttggatctgcaagttgatagttttccccaattttggaaatgttttgtcattcttcagattttttttctgcctcatt

SEQ ID NO: 412752 - DNA, 468 bp, Homo sapiens
aatatttttgattagtagtaatgctgaatactttttcctgcttaatctatttgtttatttctggcttgcctgttcaaatctgttgcctatttttccattatagcatttatcttcttactgatacgtgtttttagtgatcttttgttgatcataattaccaacttttttcttcacttgtcatttggttttcaactttgtttatggtcttttttgacctggggggtggggaatgaaatctaatccatctgtctaggatccaccctcctcaagtactccaccatggctattccaggaccacaccttgcctatgattaccctttgcctgggatggaattaacatcactggttaatgttcctgactagactttaccttgagctggagagcaaccttgataaccgacttccaaatgtatctgcgttaaccacacatacatgatcatgaaacattcataagaattctaccttttt

SEQ ID NO: 412753 - DNA, 2724 bp, Homo sapiens
ccagcctgggggacagagtgagactctgtctcaaacaaacaaacaaaaaaacaaataaaaacagcattccctgcaggagcactgggctgtctcatttatttgttcatttatacttttattcaaacaacacgtgccatccttcaacaccccaacccacctcccgtgccccctctatgcctcacagcacctgccctggagtagctgacttactgccgttactgtctcctccaaggagtggaagctccgtgagaccagatattttgctggttttgttcactcaagtgcctagaactgtgctgagtacaaaacagatgctcccaaactacgagtaccagtgcatgctcaggagaacaaatgagcaaaccaacggtgaatgtctactatgtgccacacgtcactgctacgcactgtgagggactgagaaggtctgcctgcaggaagttcacgttctagtatggaagggaaaatgagtgcaagggcaggtgcggcagctcacacctgtaaacccagcactttgggagactgaggagggcaaatcacttgagctcaggagtttgagaccagcctgagcaacatagcaaaaccctgtctctacaaaaaatacaaaaattagctgggtgtagtggcgggtgcctgtagtcccagtactcaggaggctgaggcaggaagatcgcttaagcctaggagacggaggctgtagtgagctgagatggtgccactgcactccagatgagtacagaagaagagcaaatgtgctaaacaccaaaccatttccaaaaataccccagtgtttcagaacacacaaaccatgctctactccacccccaaagtaccatccagccttctgtcccacgagtgtccagccccgccaagtcctgacacccaggactccccatgcctctgggtccgcgagttgtgctgctggggacagagatgtcaatgctgccagcacagagcccacccccaccgtcagcttgctgggaccacattctccacagtttttccccagggatcatgctttgcagaagcaccacacacagagggcacacgggccatctgggcaatgctggttgcggccttctgggctccaggcctctgtcctcaagcccctgtagagggtaccctggggcaggtgctggttggaccccagcagaggacacggtgggccagggctggagcccagaatggcctgtctgcagagctctctgaaagtccaggcctgctcagagacacaaaaatcagcaggctgacctggctctcccctggctgctgggagacccactccgcagaccacaccgagggacagggaagctagctcaccccaaccttcacttcccccctccctctggggccttgggccaacttacctcgagcttctcaaccactgcggcctaatccactcgagcgctgtctgtctttcaatgctcagttgaaagtgtgtccctggaaaatggccatctgcgagtgactgcgggtgcactttcccctaggagcctgtggccctgcaggcagcaccgggagcacccctggggctgggcctggggctgacaatggggctccagagtgtggaacgttttctagaactctgtggctgagaaccatgaggcagccggtgcccactcagccaagtcccccagaaggcccctgtgcccactgcccaggcccaccagccactcgcactgaatgcgaggcccccacccactccaccagcactggcactgagacccaaggggagctgggcttgggtccagctgctccaggtgagctggctggggaggaggatgaatagggctcagagtggaaggccacagctggagcgccaatcgtgctgccccttctcataggacccctatgacccacagatggcagggacctcaggagagatgctactctccataaaggcaaaaacaaagcctcacacacctacttttatcaaacaaaagtacaaaagcagttgctgtaagaaatatttcttcagttcattaccacaatttatgtacacgttcaacgccaggtttttcttcactgcttatttctaggaaatggtctatggtggaaacgtcttcagctgcctgctggactgttatttcttgaaaagcacactttaaaatgttctcatagctgagaatgggctgaaaagaaaagaagaaaagcataccaaagttaggagaaagacatacataacgttaccttattccaaagaaataattgtgatagaaatgaaatttgtaattgatcataccattagtgttactatcacttgacatattcattcctaaaaatcaccaagttagcaaaatcacacaaaaccagaggactcatgggaaaggtggggttagggcaaaacattcaaacttcatcagtgacacatgaaaaaagatgaccacccaataatgtcagtgctgttttccagtttggttaagaaattatacatgcggccgggcgcggtggctcacgcctgtaatcccagcactttgggagccccaggtgggcagatcacgaggtcaggagttcgagaccagcctggccaacatggtgaaacccccatctctactaaaaatacaaaaattagctgggtgtggtggtacacgcctataatcccagctacttaggaggctgaggcaggagaatcgcttgaatccggcgggtggggggcagaagttgcagtgagccgagattgtgccactgcactccagcctgggtgacagagagagactccgtctc

SEQ ID NO: 412754 - DNA, 361 bp, Homo sapiens
atagaaatctctaggaagaataaactaacgtttagtgatagaaagtagaccaatggttacatgggtctgggaataagggaggtatggaggaaagactgggtttcaaagaggcatgaaaaagcctttggggatgatgggaatgttcattatcttcactgaggtgattattttatgggtatatgtatgtgtatatatatatgtcaaaatgtattaaattgtaaactttaaatatgtgtggcttatcatatattaattataccttaataaagctgcaaaaataggccaggtgtggtggctcacgcctggaatcccagcattgtgggaggccaaggcaggtggatcacttgaggccaggagttgg

SEQ ID NO: 412755 - DNA, 333 bp, Homo sapiens
tacaggatacggcaattttccattgcagaatccattatgttgcaatagtaaacgctgaaagatttcatagatcatggaaagtataggcttataagaaatgattgtagtaatatctgagttataaagcaattttatttgtacacatagactttaagaaaagattcataatttctgatcaattttctgaatagtcagacacgaattttcttgttaataataagtcatttttgagcattagctttgtgctgggttctttacagatagtctatcactttgggcctaactattcaatagaaagtattcttattcctatttaacaaataaggaaactgg

SEQ ID NO: 412756 - DNA, 364 bp, Homo sapiens
gaggcagtggatcacttgacgtcaggagtcaaaagcagcctgagtaacatggtaagaccccatgtctacaaaaaacacaaaaattagccgcgcacctggagtctcagctaccatggaggatgagatgggaggatcgcttgagcccgagaggagaggttgcagtaagcagagatcacaccactgcattccagcctgggcaacagagtgagactgcctcaaatttaataataataaaaaaaattatctactactaatttctttaagaacacaaagctatttgtacttttctaagtgaattcatactaacttaaattgagcataaagttggcagggggcactggtgagaaggagcactagtctcaaa

SEQ ID NO: 412757 - DNA, 364 bp, Homo sapiens
aagatctaatatacagcatctataagaacttaaacaaatttataagaaaaaaacaagtaacaccattaaaaagtgggcaaaggacatgaacagacacttttcaaaagaacacatgtatgtggccaaaaagcatataaacaaaagctcaacatcagtgatcattagagaaatgcaaatcaaaaccacaatgagataccatctcacaccagttacaatggctactattaaaaagtaaaaaatgacagctgctggtaaggttgcagagaaaaaggaacagttatgctctgttagtaagagtataagttagttcaaccattgtgctcctcaaagacctaaaaacagagctaccatttgacccagcagt

SEQ ID NO: 412758 - DNA, 374 bp, Homo sapiens
ctgggtctcttggacccgtctgtgtaatgaaggtgtcacagtcgggttgagaaaccaagcgcgtgctaactgcgtcacatgagagggcgctctcgtgaaattacccgcaaacacgcttagaaaggactgatgcaaatgtcagttcgtcttaagagatgtaataaagtaagggcaggaactctgactcctacctaaatattgaaggtcttttttgcttactgagggtgttagaatgtcaggccttccctcccctgcccccgtctagagcggtgtttcccaaatacagtgggttctgtgcagggttttcagggagcctgttccccactgggtcctcactgcccctcgtagtccactgatgagattggccgcgctag

SEQ ID NO: 412759 - DNA, 462 bp, Homo sapiens
ccgatagtaaactgctacaaggagaataaagtgacagacacttttgaggaagttgcctacaatgcagcattaacagatacagaaatagaaaaaagagaggaaagatgaaataagatggtttctaacaagttccagaaggagagattagagagaaccaaagagaatcaaagataatagataaaaatttctaaatgagaactatattgagtcctaaacaatataaataaaaatgaatccactcagacataatgtagtaaaactgcagaatgccaaagacaaaaataaggtctaaaaagcaaccagaaggaaaagacacacacactcactcaggctgcagagaggacagccgggaggccaaccagctaacggcaggaagaatagcttgcaaagcagctccacagtcctggcagtgagaaggagggtagccgtggggatggagagaaaggagccttctgacaaagc

SEQ ID NO: 412760 - DNA, 497 bp, Homo sapiens
taatcatcaatcaagccttgcacgtcatcatatacttcatactggagagaaaccttacaaatgtgaagaatgtgacaaagttttcagtcagaaatcaacccttgagagacataagagaattcatactggagagaaaccatacaaatgtaaggtttgtgatacagctttcacgtgtaattcacagctggcacgacatagaagaattcacactggagagaaaacttacaagtgtaatgagtgtcgcaagaccttcagccgcaggtcatcccttctatgccatcgtagacttcatagtggtgaaaaaccttacaagtgtaatcagtgtggcaataccttccgtcaccgggcatcccttgtataccatcgtagacttcacactctagagaaatcttacaaatgtacggtttgtaacaaggttttcatgcgtaattcagtcctggctgtacatactagaattcacactgcaaagaaaccttacaagtgtaatgaatgtggga

SEQ ID NO: 412761 - DNA, 304 bp, Homo sapiens
ctccataactagcatgtatatatttatgggctatcttttaaaaagtaaccaacctcaaatgcaattaaattatgcctaatgctttgcaatttttttctgccttccctatcttagatttcttaaaaaaaaatgagtcttagctgtctcaaaaaaaaaatgagtcttagcagtgccttgcaagttgtgtttggtcaataaatatttattaataatgaggaggctgagaatgaggatattttaatggcggagatcggtttacagagctggtatatgggactctacttccccctaaatctgtttctcc

SEQ ID NO: 412762 - DNA, 410 bp, Homo sapiens
agaaataagacctgcagtgggattgactaactcagtggctaaaacaagtcatcaaataccaaggagctttatcatctttccatagaatagcttgagtgtgataactatgcttttcctcactgttttaagatagttgaagcttgtttctggcaatgaagggtgtttccttctatgtatcattttttattaaggaggaaattctttctctgagggactcatttccatgtcaatgagccatttatttgccttaactggtttaggtccattatgaccaagccactggagatggggaatcggaaatcggggatgggaagccttcactgtataaacaaaaatggagcctctgctggcaaaaaggaaaatgagagtatagctgttggttaacaactaaaaaaatctaccttgaattg

SEQ ID NO: 412763 - DNA, 173 bp, Homo sapiens
tattctccactgacatcatgatgggaggaaggctgatttagatgaaagggccagctctctgtttaactttttctgatgccatgccagcaagggtgttgagataccttgttacagccttgtgagggtggacatccaggtttcccagcaagccttttttggaatgggtgaggatg

SEQ ID NO: 412764 - DNA, 347 bp, Homo sapiens
ctcaaaaaaaaaacaaacactctgatcctaatgggagctccaaagctggtatggtccttcagaattgggacagtccttgaatataagctgccccaggaaggggccatgcccttaggcaaggtgactcttcagtggcgataactcctgaaatagcttgacagttgagtgccgtctagcaataatactccccatagccaaagcaatatttcccgtagtcttgctgggaaattggaaaaacacatcacggtatccactacaatgtttcttttatctcagtgtttaagatatgtcccaatatggccttgaccgcttctctctcagagcacttatcacactctatagttatt

SEQ ID NO: 412765 - DNA, 211 bp, Homo sapiens
acaagactccaggttttctgacctttagaacggtgatcatctaacctttccctcgttcacagatattgcttgagaacctactgtgtgccaggcacagggggcagaggggcaggagtgaccaagacagagtctcatggagccgacatttgcagacaggggatgcaggacaaaaacgctaagcaaattaatgagataatttcccaggacggtg

SEQ ID NO: 412766 - DNA, 315 bp, Homo sapiens
tgagtcaactctggatttggagaattgtgatggggcactgtcttgggaaaagcaaaagtgtgtgtgaggaatgagtgtttctgggatgctcccttctggctgcttgctcatccttttcattgatgctacagaccctctagtaagggtaatgtgaggctgaggaaggaggacagaaggcttgtttattatagaaatgccagccaacgatctatccacattagggcattaaaacactgtggggaaagcgtcattgatttgggttctaaactttctgtctttaagtggctactgatatcaagcagctgtcgttgaatg

SEQ ID NO: 412767 - DNA, 304 bp, Homo sapiens
ggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcag

SEQ ID NO: 412768 - DNA, 395 bp, Homo sapiens
gagaaggaggggtgccaaacaaaacagaccaagaatacagagtgtctgctcccatagagctgacattctaaggagagagacgggaactttttacaagtaaaagcatcaacaggccgggcatggtggctcacgcctgtaatctcagcactttgggagaccaaggcaggtggatcacttgaggtcaggagttcgagaccagcctggccaacatggtgaaactctgtccctactaaaaatacaaaaattagccgggcacggtggcaggtgcctgtaatcccagctactcaggaggctgaggcaagagaatcacttgattctcaggaggcgagaggttgtagtaagccaagattgtgccactgccctccagcctgggcgacagagtgaaactctgtctc

SEQ ID NO: 412769 - DNA, 83 bp, Homo sapiens
tggttaaatatggtggaagagtggggaagagatcttaatcatcactagaattattaccgctaataagatcaacgactgatcca

SEQ ID NO: 412770 - DNA, 233 bp, Homo sapiens
tgccccggtagaccgtctccatgacactgggggaaattaatgtgatgacaagcaatggtggctgctggcaagggtgttccattcctctttctttgcattatccttttctcctccagaaatgctcaccgaattcagcaatcacacctgggcattctctgaagtcatggaatacagtgctgaaacaatgtgtggaggagcaaaaaatctaggattttagaaggctgccatgtcac

SEQ ID NO: 412771 - DNA, 161 bp, Homo sapiens
ggttcaagaacagcctcggcaatgtagtgaaaccccatctctaaactttttttaaatgacatttgcaaacattttctcccaatatgtggcttatcttttcgttttcttgatggagtttcttgaagcacagaagtttttgtggaagtccattctgtcatatt

SEQ ID NO: 412772 - DNA, 427 bp, Homo sapiens
tattttggatgacgtttggcttagtgcagatgtttaaatcagtaatagattcaacttacacatctaagaatcctcttctttcttagtaccacaccctggaccttctcacaaggtttagaaggtaagacactctttattcctccatttactgcagtcttgtcctagtgacacctacaaggaagcacttggtaaatgctacgagatccaaatgtcaagactgaacctttaggactacctgtgacaattgttagaccacagcttaccctttgactcctgtgaaaatcaaggagggtgaggagcaactgaagaaaagtcctctgatttttattccttttttccttctataaggagctctaaggtattagattttttttttttaactggcaaaacaaaagagcaaaaaaagtcccattttcagtatctgact

SEQ ID NO: 412773 - DNA, 623 bp, Homo sapiens
tacacacaatcgatctatatctatatctagagagacacagatttcctatcactggctgtgtccactggaaaggaaaaacaatattcaacccagtgagaacagttcccctggggcccagtctttggtctccaaatatcatttctcactgaaagaaaccaggtctccttggaaaaaagctgatcccagagctaaggcaagaaatgtacaagatgagcctggaacatagtgttatactagaaagcaagaaaactatcaaagacagccagtattggattaaaaggactcagtagccaaactgaataggatcccaatgctcagacaggggaccatctgaacatgaaaaagggtaatcactgtcatggactgaaacacaacagatatgctgcaatctatgaatttacagtcatgctttcaaaacacagtgacttggtttgacactgtgaactagctgtatcgtgcaaattggtaaatagacagaatctagtatattatcctgcttttcctacaaaacctgaagcaccgggtagataaattacagatgcaaggagtttctcttcatgaacaataattcctgctaacaaatgaacaaataataatagaattagactaccactatttgcaat

SEQ ID NO: 412774 - DNA, 428 bp, Homo sapiens
gaggagagaagagaggagcatctaaacgtccagaggagttcagctggggacggttggagaggagatcatcttcccactccatcccctttccagctccccatccatcctgctgagagccacctttatccagcaataaaatcccctgcatttaccatccttcaatttgtccatgtgacctgattcttcctggacgctggacaagaacgcaggtaccaagagggcactgagctagttaacacttaagctatctgtagacagcagagctaaaggagccctgtaacattcccactggggctttgggagttgcagacaccccccaccagatgctactgtggggccagagcccaaaagcactcaatccagctcctgcacttgcccatctgcatgcttcccctcctgtaaggggtttgggtgaacaaatgagccac

SEQ ID NO: 412775 - DNA, 640 bp, Homo sapiens
tgctgggataacagctgtgagccaccgtgcccttcccaggttttatatttattcttttttccttttaaattatgtttttatttaggtattgtacgtaaagtgcttttctaacagagctttggggcagaagtgttagggcaggtcattaaaccactgaaattagttctttggaggagaagataattgttagagttgtaagtgaagtcttgatagataccttatcaatttcatagtaatgtctgtggaatttctttttctgttttttttttttttaattatttcttgaggattaactgctgatagtggaatatcatatatatagttggctcttgatgtacttatttctggatggctttccaaaaggattttaccattttacacacagttctaaatagtatatgaatttagcatttgtcccacacttagatagcactgatttttttttttattaagtgggtgcaaaatgctactacaagattgctttaattactacagttttattgatgaaaatgatttctacttgtttactgtttgtatttttttctaggagttttgtgtctatattctttgctgatgtatctttttggatttaatgttttatacatattaaatttctgtctcattggatataaatattttc

SEQ ID NO: 412776 - DNA, 146 bp, Homo sapiens
gaggagacgccggggatggcaggcagatttcgggggtcaccagcacggagctgggagcagtcgtctgaacagagctgagggacagaggtcttggggtgtcgggagtgagcagggactggacacacgtggacactctgctgcccggg

SEQ ID NO: 412777 - DNA, 250 bp, Homo sapiens
aatttgttaaatgtggtggctagaaaatttaaaattacataattggctcacagaataattataatggatggtattgctttagatcaagtttgtctaacccgtggcccatgggccacaagcggcccaggatggttttgaatgagatccaacacaaatgtgtgaacttccttaaaacattatgaattttttgtttgttttgtttttgtttttttctcatcagctatcatgagtgttagtgtattttatgcat

SEQ ID NO: 412778 - DNA, 485 bp, Homo sapiens
atgtttcagtgataaagagttaaaattcttcatactatagaggtaggccttagtttatagtagatgaactaaacaataatctaagagtctttgaaagttattgctaccaaatatcccaataaatggacacagagtacttttgattttctgcaactattgaattcttatgtgtatctatcatatctgtcatgtccatagactgaaaataacatatcctatatgcatacatgtgcactggctttaaaacatttattgaatgattttcatgtaacaaaaactgttctctgaattcttcaaggcattatccttgttgaaggctgttgattgatcatgaaccagataccgttaaaatccatgtttataagatagagattctgtaagttcctcaaagtctcctgactaatgtgcagtaagccaggattaaacacaggcattctccctccggaacccaagtctctaaccacagccggctttcatgtagatcc

SEQ ID NO: 412779 - DNA, 485 bp, Homo sapiens
gggtagcaacaaagaaatgctctaggccctaggaaggttagatttttgagaacacatcaacttgggtaacacaaaatatgagtaaaaacaaatatgagagaaaaacatatatgtaaactgaacacaaaaattgaattgaaccattaaaagttcgctgatcttatccctaaacaaacttctgggatatgtgtatttcatcattcgtgtgtttgaaattaaattttatttaactggtatttttaagctaactgttctaccaccaaaatcagttttaaaatacacttctagtttctgctacattctcatataatttaaaatcagccgtgtgaagaaaatacaaaccttagattcaaagcctagaatcaactatatacctaaaatataccagaactgattgttttataaatgagcaacagtgagcattcttctctttagaacctggctcataactcatctctcccaccaaccttctttgcttcctcaaa

SEQ ID NO: 412780 - DNA, 445 bp, Homo sapiens
ataactaagtaagttaaccatagttgtactgaagccaactagttacgatacacctgatcacaacctatctgtgtgtagatatttttctcctaaaattgaaccattaaaagttcgctgatcttatccctaaacaaacttctgggatatgtgtatttcatcattcgtgtgtttgaaattaaattttatttaactggtatttttaagctaactgttctaccaccaaaatcagttttaaaatacacttctagtttctgctacattctcatataatttaaaatcagccgtgtgaagaaaatacaaaccttagattcaaagcctagaatcaactatatacctaaaatataccagaactgattgttttataaatgagcaacagtgagcattcttctctttagaacctggctcataactcatctctcccaccaaccttctttgcttcctcaaa

SEQ ID NO: 412781 - DNA, 332 bp, Homo sapiens
caggtaagatgatttgttctttcatttcccatttggtgtttgttgccttcaactctattatcttaacagaatttaattgcaataggctgtttgaaccaaaggagaaaaaatatcaagccttggaatggctcttgtctttaaaattttttcagtatgatcaagaatgacttttatatcctatgtgttttctcctatctcatgattttttgtttgtttttaaactaaagaaccacccttttaatttgatctacgaataatctgaatttagacctctgccttttctataattgaatgctttcattctggcgttgatgatgcgtttattatattca

SEQ ID NO: 412782 - DNA, 371 bp, Homo sapiens
ccaccagtttgatgtgattagtccatcacatatatggatatttgcacatgtgacccaaggccaagacccatggattataagtctctccagttttttaaagcaagaaaatcttcctaaacactgctctacagctgtgagctatgcttggatgtttgcatacacaagacttcagttgttgtcccctcaggtcgatataaatagccccatcaatgctaagaaagtaaataccaccacaagcagtgactcatacattggcctgtggagaaactatctgatcctttgctgcagtgcagcaacatcgtcatcttccacatctgcaggttctgtgagatgttctcctcctgagacgctggcgtctaccccagatagcg

SEQ ID NO: 412783 - DNA, 272 bp, Homo sapiens
cggttctgacaatctaaaggagctataaaggtacaaatgacagaatccagggcatgccatgcatggagtccgcattaaaacctgcatgttttcagctgagaacctaaagggcttcattctaggaataagggaaaattgcataaagatcaagcttcacataaactgcaactcactttcaatggccccaaaaatctcacactctaaaactcaattaagatgaatcttagattgtcagttctcctagaagcctggcgaagaaaactgaaatcttc

SEQ ID NO: 412784 - DNA, 662 bp, Homo sapiens
tgagccaagatcgtgcacaccagcctgagcgacagagcaagactctgtctcaaaataacaacaacaacaaaaatccttgcaatatataagttctctcaatattcaaaagcataaggaacaagccggatgatcattaacaaagggtttatccagaaatacaacaaccgtcagattataggaacctctgcaatgcaatgtcatgaccactggggtttggcattggagatgcaagaacctaaatatcaccctttttggggagggccactaacttgagccctgtcataaggatcagacctaaaaagatgctcttaaaatccagagattggagaaagtcaatattcccccacctgaccagatgcctaaatcaagagtattagcacattttacaaccaaacatgaatgggctgagatacagttcctgacctctcttgccactttctgtaattagccacaccagccaccactttggaaaggtgctaaagtttacccacttactaaaaacagcctaattacacttaaaattagcaatatacctaaatccatatttcatgatacatggtcccagaacacctgcagtagacttccgggtggggaagtgggagtgagtctggctattaaaatgctgatttcggctgggcgcggtggctcatgcctgtaatctc

SEQ ID NO: 412785 - DNA, 199 bp, Homo sapiens
cccccttggcctcccaaagtgctgagattacacgcatgagccaccgcgcccagctgcatcctcatttttaagaaaataactggatccagccatgaccttccatttcctctttttcacctttaaactcctagagtgagtttacagtgactctccagttcacttctagtatcatatactgcagatatgtcacttggtaagt

SEQ ID NO: 412786 - DNA, 399 bp, Homo sapiens
gctgagatggagacagaactgctggggcgccacatgtgaaaaatagaatctctgcccaaaatggaattagattagaaatcaaagatagaaccacaacagagaaatcttatttcaaacccttaaattaagcacgtatctaaataattcataggtatttatggatgtctcagggaaattcaaaaacatttttaactgaatgaaaatatagtgtattaaaatctgttggatatacctaaaacaatgcttaaatgagtaatttatatcaaaacatcacattgtaccccataaatagatacaattatctcttgtcaaggaaaatcttttatttttgagaagaaacttgcagtattcttacattaggaagatctcaaatcaatcattgaaatttcacattaagaa

SEQ ID NO: 412787 - DNA, 588 bp, Homo sapiens
atgtgggtgtgcttaatgtaataatgagagtccttacaagtggaagagaagcagaggaggaggccagcgtgatgtcatgtgagaaggactcagtgtgctcttgctggctttgaagatggaggaagggcccatcagccaaggacagcatgcagcctctaccaggtgaaaaaggcaaggaaacagattacccacgagggcctcctgaatgtcgacactttgattttagtccagtgaaacctaggtcaggtttctaatctgcaggaaatagtaaatttgtgttgctgaaagttgtcagggctcagccaccaggcatgcatcagtgggcaatgctgtcccagagctgcccacacatggagtgcccaaatcactcctctgtaggaagtcagaaccttcaggactgtgttgcctaaggatgctaggcagggctcaggaaccagaacaacctcatgcaaaccctgacggccccttaacagctctgtgaccttgggcaaatcactcctccctgtctctttgtttcctcaaaagcaaaatgtggatgacaccaggaaggagtgatttgcccaaggtcacagagctgtaatgtagtag

SEQ ID NO: 412788 - DNA, 432 bp, Homo sapiens
agtccggggggacgaaaggcgggggtgggcgtggtggctcacacctctaatccaacacttagggaggctgaggcagatggatcacctgagatcaggagttcaagaccagcctggccaacatggtgtaacccccatctctactaaaagtacaaaatttgctgggcgcggtggtgcacacctgtaaccccagctactcaagaggctgaggcagaagaatcacttgaacccaggaggcggagtttgcagtgagccgagattgcgccagtgtactctaacttgggtgacagagttatacctctccccaccactccccccaaaaaagactttgagctgagaacccctgctgatttttactggattgaccttggtgttctcattctagccatttagtgacacctatgaccctttcattctattccttttgatccttaa

SEQ ID NO: 412789 - DNA, 422 bp, Homo sapiens
tgctgaggtcactccagaggatcccggtcgacggggattacaggcgtgagctaccacgctcagccaatatacagatttttctatttatcaacttttattgatcaattttagtcattctctattaacttcctgctatttataccacccgaatgcctttcccatgcctccaatatagccatgtcactaattatatatcctctattccttatctttctacctttaactaatagacttactctcccttttctctcttttaacttgtcaactgcacttttatattaacaaggttaatatttacactttgttctataaccataattaagtcatccatactttgccagtaggtcattctaaaagtttaagggcaataaagtgtttacattattatgattatgtaaatattgttccagaaagatccaatt

SEQ ID NO: 412790 - DNA, 455 bp, Homo sapiens
aactctagaggttactacctaaatggctgtggctgtaggttaatgagcacatttcaagtatggcagagtggaggcatgtcctaggctgcagtcatgcctgttcccatgcgaccagtctcaataatccaagattagaggctatggaagaaggtgggaagtgacaggtaaaatagggagtactatcagcctcctgatccctgggattgcggctttgaaggactctatgtctgggcttgcaggaaccatcagcctagccatctgtccctccaagaaaatgcccagggctttttactagtcttggagaggcagaatagaggacagtggtctctggtgactgaccacctcggttcaaagtctaggttggccccttattggctgtgcctgtgtaactttaggtgagttatttcttcctttctgtctcagatttctcacctataaaataggtacaattacag

SEQ ID NO: 412791 - DNA, 151 bp, Homo sapiens
tgttagaggaggagcagacaagtggcagagtgaatgagggaaaccagtgactctgaagttacagaagaccagagaaaacattgtagctagaaggaaaatgtagttatttcagtaaagtagtgaggatgaaaactcaattggagtgattgca

SEQ ID NO: 412792 - DNA, 521 bp, Homo sapiens
tgcccgctcactttgaacgcagaatctcaccgtgaggcaaactcttaccttgagagcatctggcttctgttctgctctgcccctcttggtggagatatggttcttcaggtctcaggagaaagacagcagtcagaatggatgagaagctggtgatttccagccctctgatagagcagatcgatatttttggggtgtttagttttagtttgtgttacgatctggtgtcaccgagacttgcaaacaatccgcctgtattgtgaattcggtcccagggatgtgctttatttctcctgggttgttttctcttagatgccaactgttgaaatgggggtaaaatgtaacataagaagtctattttgtcttcttctctttaaaatattggaaaacgtggcagtgttgggtccagattcctacatggttgctttggatagcaactgagtagatactgctttctccctttccaccagacgtgagttttctgcttctgcaaagtcccctttgctccccactgctttctaccg

SEQ ID NO: 412793 - DNA, 1069 bp, Homo sapiens
gccttgttaactttggcgactccatgcttggattaattggttggcctgaaccccatatctcaggctgatctaaaagaactggaaacaaaaaagaagatttcccagggtcatgaggaggacatgcacagagaaaggatccactctgcaggcattcatttgacaggcgattatcatgcacctcttgtttgttggacactatggtggtgctgggagtacagagacagagagacattggcttgataattacaacagaatgtagtgaatcctgtaagtgagtcatagaaaaagaagcagcttgaagaaaatgactaattctggccaagatgtttgtcccaatggaaaatattttgtgctatgactttagggatgagtaaatttgtcacctgagaagaagggcaaggaaattctggacagtgggaatgggattcacaaagacttggagtcatgaaaaggcatatggtgggtttaggaaaaggaatgttaagcaaggaagaatcatggggaatgcagaaataggtcaaaaactagtttggggccattttataaagggacttgaatggcaagcttatgagcttagattgtgttctgtagccagcagagaacttgcagattatttttaagagttacatgactgaacaattttaaaaattttactctttaaacaaacatgaaggagagtaatataaaaattaccctctgtacatcaaacactcaattatcaagatgaatgattttaaagcaaatctctcacctcacgtcatttctagatatgtgcatctgaatttgttcttatccaaccacaatcagttttctaagctaactaaattaaaaatattttattggcatcatttaatcaggtctacattcatatgtctcatatctttttaatagtatgtttgctcaaattgggaccccaatcactgtctcatgttgtactaggttgtaatgattcttagagatcttaattgagagcactttctcttccctccaccttgttaacgttgagttactggagaaacctgatgtaatgtcctaggaccttttcatatactccatttgcctaatttgc

SEQ ID NO: 412794 - DNA, 805 bp, Homo sapiens
atttatttattattatactttaagttctagggtacatgtgcacaacgtgcaggtttgttacatatgtatacatgtgccatgttggtgtgtatgactttagggatgagtaaatttgtcacctgagaagaagggcaaggaaattctggacagtgggaatgggattcacaaagacttggagtcatgaaaaggcatatggtgggtttaggaaaaggaatgttaagcaaggaagaatcatggggaatgcagaaataggtcaaaaactagtttggggccattttataaagggacttgaatggcaagcttatgagcttagattgtgttctgtagccagcagagaacttgcagattatttttaagagttacatgactgaacaattttaaaaattttactctttaaacaaacatgaaggagagtaatataaaaattaccctctgtacatcaaacactcaattatcaagatgaatgattttaaagcaaatctctcacctcacgtcatttctagatatgtgcatctgaatttgttcttatccaaccacaatcagttttctaagctaactaaattaaaaatattttattggcatcatttaatcaggtctacattcatatgtctcatatctttttaatagtatgtttgctcaaattgggaccccaatcactgtctcatgttgtactaggttgtaatgattcttagagatcttaattgagagcactttctcttccctccaccttgttaacgttgagttactggagaaacctgatgtaatgtcctaggaccttttcatatactccatttgcctaatttgc

SEQ ID NO: 412795 - DNA, 472 bp, Homo sapiens
attaactttctgcaggtaatctctgagcttcgggagaagttggatcctgcagcattgtgttttgccatcactgttgcaggctttccaagtaaagttaaaaagtaaaggacaagcaaggcaattgaaaacactgcctcagtatctgaacacaaggatcttgctctgtcacccaggctgcagtgcagtggcgtgatcatagttcactgcagcctgaaactcctgggctcaagcagtcttccctcctcagcctcttgagtacctgggtctacagagatgaggtctcactctgtcacacaagttggagtgcagtggtatgatcctggctcactgcaacctccacttccgaggctcaagcgatcctctcatgtcagccttctgagtagctgggaccacagattggagaggacgaaggccctgaggtccaagaacattgaaacctgacagtggatgccaatggctgtggggaggagct

SEQ ID NO: 412796 - DNA, 1027 bp, Homo sapiens
attaactttctgcaggtaatctctgagcttcgggagaagttggatcctgcagcattgtgttttgccatcactgttgcaggctttccaagtaaagttaaaaagtaaaggacaagcaaggcaattgaaaacactgcctcagtatctgaacacaaggatcttgctctgtcacccaggctgcagtgcagtggcgtgatcatagttcactgcagcctgaaactcctgggctcaagcagtcttccctcctcagcctcttgagtacctgggtctacagagatgaggtctcactctgtcacacaagttggagtgcagtggtatgatcctggctcactgcaacctccacttccgaggctcaagcgatcctctcatgtcagccttctgagtagctgggaccacaggtgcgcaccatggtgccccgctaattttttgcaattttggtagacataaggtttcgtcatgttacccagactggtctcgaacttttgagcttaggagatctaaccacctctgcctctgaaagtgctggtgttacaggcacgagccactgtgctcagccctttgcccgtttttaaattgggtttttgtcattgttgaggtataggagttatttatatattctggatattgatcccttatcagacatatgatttgcaaacatgttctcccattctatgggttttcactcccttgatagtgtcctttgatgtacaaaagtatttagtttcgataaagtcaaatttatctttttttttttttttggagatggagtctagctctgtcaccaggctggagtgcagtggtacgatctcgactctctgcaatctctaccttgcgggttcagacaattctcctgcctcagcctcccgtgtagctgggactatgggcctgtgccacaacgcccaactaatttttgtatttttagtagagacaggttttcacatgttggccaggatggtcttgatctcttgacctcgtgatctgcctacctcagcctcccaaagtgctgtgattacaggcatgagccaccaca

SEQ ID NO: 412797 - DNA, 360 bp, Homo sapiens
ttttgtaattttagtagagatgggagatttcaccatgttggccaggatggtctcagactcctgacctcaagtgatccacccacctcggcctcccaaagcactagaattacaggtgtgagccaccacacccagccagtaccacattttctttatccagtttatcaatgataggcattcagattgagtaacttttattcaacaatttttcacaagtatatgcagtgtgcccatcatgccagccactgtcctaggtgctgaggacacagcagtgaataaaacagaccaacagaaggtctaggcttttatatgtcctagacatattagccttttagtttcttcaccaatgtaaaggaaatgttt

SEQ ID NO: 412798 - DNA, 178 bp, Homo sapiens
aaatatcagccggtactacatgattgctcatctcccctgggctactgctactggtcttgttttcacttttatttcccacagtccatcctctatacagcagctagagtgatctaaaatgtaaatcaggccatttgaattctttgcttaaaaatccttcaatggcagccgggcgcggtgg

SEQ ID NO: 412799 - DNA, 680 bp, Homo sapiens
cataagagacaactatgagcaatcatatgccaacaaattagataacctaaattcctggaaacatacatcttatcaagactgaatcatgaagaagttgaaaatctgtataaactactaattaaggaagttgaatcagcagtcatagactgcccaaaaaaacaacccaggacctgatgcctttactggtgaattctaccgaatatttaaagaataaacaccagtgtttctcaagctctctcaaaaaattgaaaattgatgagagaaaacttcaaactcattttaagaggccatcattaccatgataccgaagtcaaagacactacaagaaaaaaaaatgcaggccaatattgttgatgaagatagatgcagaaattctcaatgaaatactagcaaaccaatacatgaaaaacatcatacaccatgatcaagcaggatttattcctgggatgcatttatgtctgtggttcaacatttacaagttgataaatgtcatacattaatagaataaattacaaaaaccatgtgattatctcaataaatgcagaaaaagcattagagaaactttaacattttttatgataaaaacccgcagcaagttaggtatagagggaatgtacctgaacacaataaaggtcatatatgataggcccaaaattaacgtcatactcaacagtaggaag

SEQ ID NO: 412800 - DNA, 715 bp, Homo sapiens
tgcaaccaggtcttggggttggtgggagtgttgggctcaactctgaatgcagcatgagcaagtgggaattcatagcaaggagtagtgtaggagtcagtgggtggaaaattactaaggaaacatacagtggtgagggggatttggctaaaccaactgctatggtttgagtgcgttccctaaatttttatttcttggaaacttaattcccagattcatatattgatcgtatttggaggttgggcctttggcaagtaattaagattagataagtcaccagtgtagggcccccatgatggcattggtggctttgtaagaagaggaaaagagacctgagcttgtgtgcacttgacctcttgccatgtgatgactggcaccatgctgtacaactttccagcttccagaaccacgaactaaatgagcttctattctttataaattacacagtctggtattcagttatagcaacagaaaactaggacaccagccaagcaggattcctgctgaatattggccagggtgattagacatcacctgggagatagtggaggatgagaaccctgatcagatatcgagcatatctgtttgagatactgatttcctttcctttggatagatatccagttgtaggtttgctggatcatatggtagttctattgttaatttttaaagaagcctctattctggtttccattatttccaccaatagtgtacaaag

SEQ ID NO: 412801 - DNA, 337 bp, Homo sapiens
accgcatacagcaaatacagaaacatctatgtgacaaatattactaaatcttggaaggaacagtaagaatctgtggcttttgagccacaaacccagccctaccccacaatgtgaggaagctctactccagggacataacagccaagaacacagggctctctctcaccctaactcccagccaagggctacggtttctccccagaatgggtagccagccagccagtatttctcatacaccccagctatatgctgcagaaattctgtaccaggcaaacacagctagaggtctagggctctcttcttccatccaggcaccactcctgcggcagaagctcta

SEQ ID NO: 412802 - DNA, 506 bp, Homo sapiens
agcctggacaacagagcaagatcctgtctcagacaaacaaacaaagaaacaaacaaaccctgaaagacatatattttcatggatcaattgtgtctatcgaaggcaaaatcagaagttatgtaaaagaaagcaaagagataaaggaaaaaactacagacatttaacaaataatgacctgtgttttccttgccctgggtgaagtgctgatgagctggcagtgagcaagcaggccaggtgggatgttctgcccgggtgcagctggaggggtcatcaaagaatcactaggttatttttgagttctccataactgggtgtctgtgggacatgtaggtgacgggtctctggctagtacctccatctcatttatgccaggtgtttaccatctctcttatcaaaatttctcaagagactctgggacgtaaatgcagaggctgcgtggggaggtagaaacacaggagctataggcaaacagggacaagaagactgaagagaaggacaggaagaaa

SEQ ID NO: 412803 - DNA, 355 bp, Homo sapiens
gaaacctcaatcagaactccgaaacaatgaggctgggagagcttccaggttggtaaaagcatttatgagctaggagtggcacaccagaaggggcatggaagctctgcacccccaactcataccttgccctatgcgtctcttccattcagctgttcctgagttataaataaatcctttgtaacaaaactgtaatcctaaatatcatgctttcctgagttctatgactcatgatagcaaattatcaaacctgggatggggagtcatgggaacctccaaatttatagtctgctgggcagaagttcaggtaacgtacaaatacccaatacctgcagctggcatctgaagtggggcaatt

SEQ ID NO: 412804 - DNA, 589 bp, Homo sapiens
tgggtcaatcttgttagctaagtaaacctcaatggtatctgcctctaagctctgtttggtgagtctctgggacccaactaatgatggtttagtgtcctttaaagaagaatttaaaataatccagtacataggatttcttattgtgcaactttccaattctgaaggaagctatagggcaactaatgttaactaaactgctatgtctccctgttgggtttgcaaagccactcagtactgtgtcatcagtaacccaggaacaaagagggcagtcacacagtaacatcaacacccactgggtacacagagttgcccacttttcatgactcttccacgtgtaagggtcacaaacttgggaagctggtggctgtgttattacccatttagaaacggggaaacagaggattagagggaattatcatcttgaacatctcatatttttaaaaaggaactctaataactacctgacaaattggtgagtgaagagtcttagccaaacactcaatgacaatagtttgaggaagaagcaaagtgtagtagttagaatggtgatttctgagcaagaagatgggggctctgtattcctggccaa

SEQ ID NO: 412805 - DNA, 388 bp, Homo sapiens
acagtgccaactggccccacttagaaggaatgctttcttggctcaattcaaaaataagaaacctctgtcatccactcccctctgcccaattatgttctcctttccacaacttaccccgctccgtgtcaaatgagtttcagtttcttccctccaactctttggtgtattttcaaatgtcagaaaatacaagggaggtgtatataaggttgaatgtaaaagtaacgtctgagagattaggcttcccagactaaactcaaacctagtacagggctcccatataagaacaaggaaacaggagcacacacagcacccatctacatgtttcaagtaaggaaaagagtaaaccttaagcggctatacacgaacattagtggtaacacgattacta

SEQ ID NO: 412806 - DNA, 373 bp, Homo sapiens
tccccctctccatgctgacaaggtactgcagcagcacaaaggaaactgatcccctgggcacaggctggacacccatcgtataaccagatcccaggggacaggtgcactgcatacttcatgggtgcgctgagcagagtcatctacatgtgtatgtacacgtatatatatgtacgtgtctatacatatattttccattaaaaaacccataaagtaaagctcctacacatcccccgaggcagttcctccacctctggcgctatgaacatctggggctaaatcattcttggttgggggggggctgtcctgcacactgtaggatgtttggcagcatcctgggcctctacccattagatgccaggagcaccacccattt

SEQ ID NO: 412807 - DNA, 489 bp, Homo sapiens
cacggacttttgtaagactttagttccatctcccacttccctcctatgctgcaacagagcctaagatatgccacaaaagatctaatttgaggtgagacattttgctcaagaacagtccacttcatttcaactaagtgtgtattcttctccagtgaaggggaagagtttctagtccatcttccatgggtcttgtgtaccttttcacagaagaagcaatattttcctaattgaagatgaagtacaataaccagaagccaagagagtgagattctagttttacttaagtgactatatcttttccctctctgggtctcagtttctcaagctacctgttactgaattctcattccacaagttttgaaaaacagatttagaagaagccaggggttctcaaaagttcatctatagttaataaattaaggcttatattaagccgaaacagatgttaattacttccaatttaatcattctctcctgttagaatcagtt

SEQ ID NO: 412808 - DNA, 199 bp, Homo sapiens
cactaactagctttttgctttgggaaagttatttctgctttctgtgcctcacttttctcattgacagtcaacagagattgggctagaggctatctaaatttccttctacatccagtgctcagtgaatcatcaagtcatagctatagaatgtacattattaccatgaaattgcgtcatttcctatgccgtaatgataaag

SEQ ID NO: 412809 - DNA, 240 bp, Homo sapiens
gcagaccgtttaagcccacccagaatcccaccaggactagacggctcccactaggctatactagatatgtggacatagaacctacgctaagctgcctgaccagtggacaggtagttgtgttattggcactattaaaaccatctttcttcctactgcccataaaaacaggcgaactcctaggcttccctgtctatgcttcccgcaaaaagaaaagcatagctattaaaaaattgaaaaata

SEQ ID NO: 412810 - DNA, 363 bp, Homo sapiens
catgtaaggtcgatctaaggatcccgtctgtgactacccacacaatcacacccagagctgaacaggaaatacgcgtaagtacgtttcaaagagccagcaccacttcatgactgtgaagtgatgatgggaagtaactctttcacttgggcatctttggcaccacaaataacccactaaacatggttacaacaattgttcctgtttcaatgatttgaaagacagctcaatttggaattgattgtgttcatgggttatctaggcacacagcttcaaacaaaaatgcagcacaaagatctttgtgaatataagcaggggtgagaagtttatttccatccttttcccattgctctgtcatcgactgaa

SEQ ID NO: 412811 - DNA, 217 bp, Homo sapiens
cccctaacaggattgggagaaccaaccaacactccccgaatagggactaactcactcttttcttggcctttatgaaaggaaggagttaaggctcttacagctggagactccagcaagagttgtaggctcaacgtgtagcttatactatttacttaattaacatgtaaatggattttgagttctgaatgcttgttctagttgattagggctcatttag

SEQ ID NO: 412812 - DNA, 377 bp, Homo sapiens
gagggataaaagactagatattgggtacagtgtacactgcttgggtgatgggtgtaccaaaattttggaaatcaacactaaagaccatcctcaggtaacaacacctgttccccaaaaactattgaaataaaaaaaaatgcaaattattgggccccaccccagacctactgaatcagaatcttgggggatggtgcccagaacctttaggttatagtaatcctgcccaacctcttaagaacaaatatattggagtatacatgattcaaagaagagctttctccaaagtattctttggaaataattgcataaattaggattattccttccatcaatgtatgatatactttgcctataaaatctctgggtgggcatggctg

SEQ ID NO: 412813 - DNA, 284 bp, Homo sapiens
tagctatcaaattctaatcttcaaaatttatttgaaatgccctcctctaccagggtgcaaaatcaacacacaaaaaccagttgtgtctctatatgccagcaatgaacaatccaaaaaaaattaagaaaattccatttaccatagcatccaaaagaataatatacctagctgaagaggcaaaaaaaaattttttttttttttacactgaaaactacaaaacacggctggccagagtgcagtggtgtttacaactaactgatcacaaccatttacagatttatttg

SEQ ID NO: 412814 - DNA, 199 bp, Homo sapiens
gtcttgctgtgttgcccatgctggtgttgaactcctggcctcaagtgagcctcttgacttggcctcccaaagtgagccaccatgcctagccatctatatcttgattgtggtggtggttacttaagtgtatgctcgatcagaatacaatagaacattttcatcacaacaagaatatcacctacctcaggagttgctgttc

SEQ ID NO: 412815 - DNA, 286 bp, Homo sapiens
cccaagccaatggaggtgtccactcacatagcaaaaagatgtccttcccaaactcacctgctgcttcctcggtacaaatcccaactttcccttgctcactcaaagaactccacttgattcaacaaccattttttggatgtacagcacatgtttggtgctatgtaaggtgatttaagaacacaagggaaacatatgctacagctttgttaatatagagggaggagagttacattcccaatgaggaagtggcagaaaaatgccttttccaggtctgtaactaaaaagg

SEQ ID NO: 412816 - DNA, 247 bp, Homo sapiens
tccaggctgaatggtactcttttgtacgtgtggaccacatttcatttatccattcatccacgggagggcacttgggttgcttctgctttttagctattgtgaataacgctgctatgaacatagctgtatgcctttgtcttttaaagcccaaatctgatcaagtcactccccagcttaaaaccttccactgctccccagcagtgggataaaggccagtctcccctgtaggtctctcccgccagccctg

SEQ ID NO: 412817 - DNA, 94 bp, Homo sapiens
taggcactccagtaaatatttgttgaatgtatgaaacaaatggttttacctctcaattactaaaatcatcacacctgctccaaaaccaagtttt

SEQ ID NO: 412818 - DNA, 183 bp, Homo sapiens
ggtccgatctagaggatcccgatcagtaactgatactaacttcacattaaaatgtatttcactaatacaaatagtaataatgaccatcacaaaaattttagctaaatattaattgacctttatctgtatactttgactgtatttagttatttaaatactcacaatcaaaatatacagatacaa

SEQ ID NO: 412819 - DNA, 358 bp, Homo sapiens
ctgttctgtctggatgatttttttggtctatgtttgacgccactgattctttattttgctgtctacattctgtggttgagctcttccaattagtttttgacttaggttattatgcttgtcagttctgaactttctattaggctttaaaactatcttctatttccttgctgagacatttctattttttaatttgtttcaagggtgtttgaaattgctccttgaaggatttttatgataattactttaaaagtcttgtcagaaccaaatccagcagcacatcaaaaaacttatccacaacgatcaagttggcttcatccctgggatgcaaggcttgttcaacacatgcaaaatctgcgtg

SEQ ID NO: 412820 - DNA, 408 bp, Homo sapiens
tactaaaaaccttgccccatggtgtcattgtattttctatcagttatgttccagtaactttccagttattttccagtaagtagccaattgtataagcactcagattgcatatctttatcttatctataagattatgagagccctatttaatgacttgataaagtacaaataagttttctgcacttctttcaaatactcacccagcaactagattaaacatagaaaataaatcagttttatttactgcgttcttaatcatcacatactgcctcctttcctgtgtgcccccaaaccctaaagcaaacaaataataggagattttgtcagttctaccttcaactttattactaatctgcccttttctcaccacgtgcatcactattaccctggtctgaaccatcttcgtct

SEQ ID NO: 412821 - DNA, 163 bp, Homo sapiens
ataatggaacgaacactggacacaggactggggaagactggatttcagcttaggagaagagtattggaacagttgtgctgctgccagcgatccgtgggagctgtgtacagattcagccgacaactatgagccttcgagatcatcttaaatatcttgtgttgtt

SEQ ID NO: 412822 - DNA, 304 bp, Homo sapiens
ttgttttatgacccagcacatagtctaccttggtgaacataccaagcacacttgaaacaaggtgagtttggcaaggtatagtgttctggaagtattaggtatcaggaaggtgaaagtggttgagagtgttatccagattatctatgtttttcatgatttttggttagctgttccatcatgggctaagagagcattgctgaaatctccaactatgacggtggacttctctatttcttttattctgtccatttttgcatcatatactttaaagctctgttattaggtaaatacacatccatgagtt

SEQ ID NO: 412823 - DNA, 519 bp, Homo sapiens
atggctgttacctaaatggctgttacctaaatggctgttacctaaatgctgttagtaggtgatcccaaatcaccgtctctccagaacttgccctggtgtgtggcagtccactacaaaaacaccaccacaacaatcaatgggtgccaagaaagggcttctcccatatccttcatttggaacaagattaatatttgggattacacaggaaactcaatatatactgtaaaatatttttttcctcaaaatgctttttaatgtcaactccccatggctggtgaaaagttagttttgcaaaagaataaatcttatcacttgttttgactctcagctaacagagagctgtgtgacacggtccgaatgttctcttactcttgtgggaggctcgggccatcaaaatttcattagcctcaaagcagttctagtaccttcttaacttgaactgttggcctctttatcaataaataaatggaatctaatcccttttagtgactaaattcttctttgaaattgtagctagaa

SEQ ID NO: 412824 - DNA, 374 bp, Homo sapiens
gcctgggggcgacctagaggatcccaagctccaacaagattaatatttgggattacacaggaaactcaatatatactgtaaaatatttttttcctcaaaatgctttttaatgtcaactccccatggctggtgaaaagttagttttgcaaaagaataaatcttatcacttgttttgactctcagctaacagagagctgtgtgacacggtccgaatgttctcttactcttgtgggaggctcgggccatcaaaatttcattagcctcaaagcagttctagtaccttcttaacttgaactgttggcctctttatcaataaataaatggaatctaatcccttttagtgactaaattcttctttgaaattgtagctagaa

SEQ ID NO: 412825 - DNA, 451 bp, Homo sapiens
actgcaagctgtcaagggaaccacccagagctttctcaggagcctcgttggacatctgattctctgtcaaagctaggtactgcagccgggcgtggtggctcacacttgtaatcccagcactttgggaggccaaggtaggaggatcactcagaagatggaggccagcatgggcaacacagtgagatcccatctttacaaaaaacgagaaaaaaaaaaatagtcgggtgtggtggtgtgtgcctgttgtcacagctacttcggaggctgcatcaggaggatcacttgagcccaggagttcaaggctgcaattagctctgatggggccattgcactccagcctggatgacagactaagattctgtctcaaaaccaaaacaaaacacctggcaagatagagaatggattggtgacgaccaagcagacggaaaatgaaaaaggccctcccagctgg

SEQ ID NO: 412826 - DNA, 167 bp, Homo sapiens
tctcggcggccaagcccgctttctgactcctcatcctggcttctttacatgcttctgaagtcagtggcttcctactctgggctataaggaatacttttaaaaaaagagcagatttaagtgaaacaatccccactccatattattcctaaatgctacttcagcaaaaa

SEQ ID NO: 412827 - DNA, 640 bp, Homo sapiens
cttttagtttcttggtgttaatgattttggagtaaggtgggggttcaagagtcagctctacaatttacacatagtgtcaagtgtaaaatgggcatctcaacattatttacaggattttgaaaactacagtatttagcacagtgcttaacatagagtaagtgctctgtaaatgataatttacaatctagggatatggcaataacagcctctaaatgtgaaaatgacctttagagtgtaaagtttaactgctttatctctgtatcctgtatccagaatagtaaaaccgctgaacgagtttctttccttatgcgcaattggaaaaaaaaataaaagcaacagtagtaactagttactgagcacttaatatgtgccagatgctgtgcaaagtgtgctgatcgaatttttacaactctataagttagatgctactgtcttcattctacacttaaggaaacccagtctccaacttgcctaaagtcaccgaaccagtaagaaaagggccagaaagcattttgactctaaagctcaaattcttaagcactgacgcttccaacctgactttacagattgaaggtggtttggaatgagtctggctcgcgaggggacagagagggaagtcgaaagaaggaggctgtgttca

SEQ ID NO: 412828 - DNA, 533 bp, Homo sapiens
tgttttgtcagtctcctctttatgttcaccttcatgctgatttctctggaatccccttggccaagaagggtccattcagcttgttggtgcgggagctcaggatttcatttttagttctcacatggcaggtgagtgaaaacgttataagggactatccaaacctttcccgaagtggctgtagtatcttaactctcaccagtcgtgtgtgacagttttggtgtctttaaaagtcggtggtgtcaagatttcacaactacctcttctgctgattgtgtggttctatctgttcgtggcttaaacttgcatttccctcatgacaaaaagtgtgaaaccatcagtcatgaactgtctgtccattccaatctcttctgttcatttttaaagtggggctgtgtatctttttattgatttatgatcattctttctatattctggatacaagatttttgtgtgggatttgttttgcagtatctccccagacttcctggtcattttctttgtagtgtcttttgataactagagcattttccttc

SEQ ID NO: 412829 - DNA, 671 bp, Homo sapiens
tattctattcttggcaggtttctaagtttttctatggcattaaggtctttaaaaattctttgaggtgagtagatacaataaactattccacaggtgaggtgcttggcatagagagttcacgtttttaagttaatttctaccaaggaaaagaaaactttttgacctacattaccagagatgaaaaaaagaataaagtgaaatagaagcttcactatatcatatgtgctgaggtgttttgggctctgataaaagtttttccgatttttttgcaggatcacatttgaaatcataggactgaaaattatgaagcagaaacatttgtccttggtgtttctgaaatatgtgaaccaaaccccaatgcctgcacttttactctcacaaacttctgacatgaggaacagatttttacaaaatagcttaatatagaagtctcgcaaaatgtgcagatttccccagatcccccaaaacaatggaaaagcactcagaccacaaggccttcaagggaataacagaaagaagaggagaacttcggctgtcactgtgaatgccctggaatgttagtggagggacaggaggagccttagaagatttaggagcataataagcatagggtaggaaatgtccatctgtggcagcaaaagaagtaaatctaggatcttccagaaccaatt

SEQ ID NO: 412830 - DNA, 314 bp, Homo sapiens
ctgggattacagatgtgtgccgccacacctggcttatttttgtatttttagtagagatggagtttcaccatgttggccaggctggtcttgaactcgtgacctcaagtgagctgtccacctctgcctcctaaagtgttggaattacaggcgtgaaccaccgcgcctggccaaaaatgtttaaccatatcatctaacgctttgcttagtccttaatggctgcattacatgtagaatcaattacgactccttcaggaacctgcctgcttctcctgcttcgtttctaccttttttcctgtccctcattatgctgtggc

SEQ ID NO: 412831 - DNA, 578 bp, Homo sapiens
atctgtttctccacttttcttaatatgtgttaatatatttatgggctccagtgtttggtacatatatatatttaattattttttgacaaattagactcatcattatataataaagttctttttttatgacaaattttttttctataagtctatgtagtctgatataaatatagccacttctacactgttttagttattattggcatggaatattctttttcatccttgtaccattaagctatgtatgtccttaaatctaaaataagtcttttgtgcacagcatattgttgattttttaaatctattcagacattctgtgaatgttttcatttattttttgcttcaataacagaatatcccagagttggtaatttataaagaatagaagtttacttagctcagaatcctggatgccaagaagtccaagagcatatcattcccatctgatgagaatcatacttccacatcacaacatgaccaaaggcttgaggatgatggaaggtgtacaccagagctcacttttataatagacccactctcatgatgactaacccactgtggaaatgatgatactaatc

SEQ ID NO: 412832 - DNA, 571 bp, Homo sapiens
ccaccgcgcccagctgacttattaaagggatccaagcccatgttgttttcttgaacatttctaatagtttcatttttgatttgttttttccatttttcatgagttgcaaattgaactttgattgacacagagtatcaggtggaagccagatttgacgtatgccagtattagactttctctttccaggatagaccagcccaagtgaagtggcactgacattgcatctccctttggttagcgaagtcttttataatattgtaaacatggggtttttttctgagaaataatgatagcacatttattgatcaccatgctcttaaccttttctagttataatttttcttagttattttattccttgtaaacacacttgtatagtgtgtttcagtgttcaaagcactctagacattcttacttgattctgacaatagccctatgtagttaaagcatgtgatgttattttgatttcacagtcttaagtgacttgcccaagatcacatagccaacaagcatggaaatagggtgaagaaaccagttttttccagttcacagtccagtaatgtttcttgaa

SEQ ID NO: 412833 - DNA, 380 bp, Homo sapiens
ttccaagtcaaagcaaggctctcactacagccgtgttaagtggagctctgtcgccggcaggcgtggctggtaacctacagcagccctggagcagctcctcaagttgttcacatctctgccttctcattccaagctcaaaaagggcaacggtttcattttgtccctaatgggtcataaggcaaaatcctaaccttcaggagattcgggggatggagggcattgcctgtcactgtgagatttgctcagggatcctcaagtgaaagctgggtcaccagactccaaacctcagccacgtctgaccactgttggaatcgtcttcctggaggactatcttgcagggtgggcctgtgggaattggttccatggtgcccagagctgtt

SEQ ID NO: 412834 - DNA, 741 bp, Homo sapiens
ggaggctttgggaagaattatttctaggctcatttaggttgtgggtagactccagttccctgcaattacaggatgagggcctccggctctttgctgcctcgtagctgggaggcatcctcgactcctagagatctccctctggtccttgcccttgagcccatatcagaactagcaacattatgacaaatccttctcgtgcttgggatctctctgatgtttttttttgtttttgtttttgctgcatctctttgcctccagccagagaaaattctgtttttaagggctcctttgattagatcgggcccacctatagggtactctccatatattaaggtcagtaaccttaattgcataatgcaaagtcccttttgccatgtaatgtaatatattcacatgttgcagggattaagacacagacatccttggagctttctgcctaccatgaagaatcattccaattatcagggatcttaaaatgtgaacaaaatatgcttcttagaattgatgaaacaccatatttggcttaggaataaaacagctactgatatatttaaagtacttagggtgttactagtaagtgctcagatgttaactgttgttataattgacatcattatcatagtggtcacgtaatatccatcatctttaatatcaattaaacttatttctacagttaaatgcatttattaaaccctaattgagagagtatagtgtcccggcagtaaactggatgaagctgat

SEQ ID NO: 412835 - DNA, 170 bp, Homo sapiens
ctgcccactcagccttccaaagtgctaggactataggcatagccattgtgcccagcctgttatttttctttatgacagacatctttaaaaattttatttaatgttttgtaattggttataggtggtgtatagaaatgctgtttattttgcttaatcatgatttgatccag

SEQ ID NO: 412836 - DNA, 497 bp, Homo sapiens
acccagaagagggctttctcccagaactggaccctgctggcccccaattctcagactccaacctcggaactgtgagaaataaacctgactaaggttagacctgactaagacaaatggatactgctgcagtgatctttccacatagagctttttctcttctttgcaaaaatttccttaggacaaattcccaggagtgggattaccaggtcaaaagtcattaatattttaaatggctgtgtgaattgacataatgcttcacaaaagaactgggctgatttatattttagccaatgatgtagatatatacaagtttcaccagcccctcttgggatcttagcccttctaatgcctgctttctaacggcatagcgagaccatattgtaaaagtcatttgatttcttcatgtgttattcagggattgctctcatctcctccaagtctttgctcaaatgttctcggtgtggtctaccccaattactctatttcaaatgaaaaca

SEQ ID NO: 412837 - DNA, 386 bp, Homo sapiens
agctatcatttcatgcatggtatcaacagtatacaatgagtatacaataatgccctctttgttaaaattactttccattctctccaacacaaaattttctccattcttttcaaaatttcaatctccaataattccatctcacagagaaaaagcaatcaagaaatcttgcaacgtctagctacaaaacaccttattaactcctaacacctctcaatctggcttccactctctgaggctactgattggactttttaaattcacatttaatctttcagaaacacctgacattgctgatcaattgaatccttgaagcattttcttcccttgagtggcaggttcaaaaatgctaccttgaagatactgggtcctaacctttggaagctgcg

SEQ ID NO: 412838 - DNA, 176 bp, Homo sapiens
gggaggtgggagggggagaaggagaatcagagaagaaatttctttgcagccgcatggtggtaccaggaggacacgtccctgacacacggagtcatggccatggtaagactgcaactgtcctaacgggaacttctgtggactgtactaaaaccacaaaaaagggcttcatgacaaac

SEQ ID NO: 412839 - DNA, 214 bp, Homo sapiens
atagacaggtgaaaggcaactcagaggttggcttgggtgactgagttgaaatgaggtcagaacaagggacagggagtttctagcgtgggtatttgggatgtacatggttgctacgtatttctgtcaacaaggtgagctgaaagtacctgtagaatatctccaaggagaacatacaaaggatagctagaaacatgagcctgaatgtcagggttgg

SEQ ID NO: 412840 - DNA, 451 bp, Homo sapiens
cattcatattagctagatacagtttttatcagaaaggcggaataaatgtttaattctttatttgctagtttttaaatagtgaattggttcccaagaatcctccagactgaaagaatgagtgtttccctgccccccgcctttgggtatcactacgaatgcatttaaacagttttatatgtttccgttcattgaagatattatttttaactggcgctcaagttgtttggccattggagggacttcttcacattgacttctaaatcttttcaacataatcctagtagatgggaatagtaactttgccgtctagtgtagtgtgatatgacagtctgcactcttgtgagaattcttcctcagacttggaatcagccaattttttagggaagctttgttaacaaaaagtgacaaaaaaaaagagagagagagagaaagaaatagtgcagagattata

SEQ ID NO: 412841 - DNA, 560 bp, Homo sapiens
gttgaatgagtgaatgaatgaatgacaagagtctctaagtatttcattacttttgaatggtcttctgtgagatgtaattcagataaaatgggccatttgtttgtgtcataagggcaaagatggagaggtaagaagatactacatcaaataaacttttctcatgggatactaatctttctatacacagtagcaggaatatcttaaatgtttctggagcattttcattgcaaagcagtatttgccatcttcatttcccaaatattagctacaacagacaatcctgacataacagatatatggaacatgagggagaagtctatatcctgagaaatataagtttataattaacttaaaaaatctcatattgatctaagttatgaattctatggtcattaattgagattaattaaaatatatctcccatgatgtctaacccataatatgttctcagtaaatggttttgtaattgaactgagaggctgtggccttaaatgagagctgccaaaacttaactattttgaaaagaatgtgtttagatactgctagacaaagctgtatag

SEQ ID NO: 412842 - DNA, 314 bp, Homo sapiens
tgatgaggccctgttacgcgtcaggctcacaccgctggccttcaagctgagggtgggaagaggcatgctcatttgaccaaggagatcctcaggtgggagacccatgttctcactcaagcaagaccttacctgggagtctgctgggaccctcatctgacaggctcggggtccgaggcagccctgccctgcagtcagccatcagtggtgtcctctagcagtggccatgctgatccctccacagaggggcctgtagagttgcccctggtccccaatccttagggtgatcgcttacttgcctcctccctaggacaaaa

SEQ ID NO: 412843 - DNA, 256 bp, Homo sapiens
cctggatagagaattttcttgagcccctttttaaaaggtagaccttctggtgacaaatcctctcagctttctttcatcaaatgtctttatagcccttccattcctaaaagacaaatataccagatataaaaaccagaattgaaagttattttatttcatcacatagacagtgttgtgccacttttctatggctttcatctatttctgatgtttcctgcttccatttgtattgttttctctcctatagatgagctat

SEQ ID NO: 412844 - DNA, 329 bp, Homo sapiens
cctgtggcaaaaaacctttttaacgtttaaaaaaagtagtttggagccaaaaataaaaagcacatttcccttcagactgtgacttacactttcctggagctgggaaaaagcatgagaatgcacctgaataaatatgcacattgtgtaatctatttaggtggtgagaagagagaatctgcttgacactgcagtgaacaattcaaatcacagcaaagaaatgcatttatgcatattttaaacaaaaggatgattattctttcatggtcctgaagttgaaaaacaaatttgaaatggctattacaaacacccactctcaaataaaagtttct

SEQ ID NO: 412845 - DNA, 351 bp, Homo sapiens
gcaaaatgtgcgtttaccctatttggaaaagtttaagtctaagccattcaggatcagcttagattgtgcaatccaaccccagccaataagggaaggacacagaaacaggaactgtgttaggattaaaaactccttccctcctttgttaggtatgctcttctcttgggattgtaacaggtgcaagcagcacccttctgctgacgtaaaggtgccttgctgagaaattgtccaagtggggatttcttttggctactccgagcacatgtctccaacagttcattttgattgctgtatagtattctattgtacaagtatgccataatttacttatccattttatcactgatggat

SEQ ID NO: 412846 - DNA, 1450 bp, Homo sapiens
  misc_feature (1)..(2): n is a, c, g, or t
  misc_feature (1155)..(1155): n is a, c, g, or t
  misc_feature (1285)..(1285): n is a, c, g, or t
nncaggacagtagtgcctggccccagccccaggcagccacagcaggctgccttaccccagaagcagctggtggcgcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctgagcctgagagagggggtcacagtgatagggccaccctggatgggaagacctggagggcagccacacagctggacggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaagaacaactcctggccaggccctgtcctccccacgtacccctgcatccccagcctcgacccaggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatgggaaaaacaaaaacaanaccaacaccccacaccacacaaaacaaacaaaacaaaaacaaagccccggcgctttttttgcggggccgcggacaacagagggttatacaagggaccacgtggtgtcaacttgtgtttccctgcaccccntttttttgcaaaggggggaaaatgccgaggcccccgaaagggaggaggtataattccaaaccccgtctacttcttgcatacgcaacagaagcaacacgtgaacaccagaggggtttaagaaagacgtccatcgcaactacacaacatagcacgtcacaccaacgt

SEQ ID NO: 412847 - DNA, 1486 bp, Homo sapiens
  misc_feature (1)..(2): n is a, c, g, or t
nncaggacagtagtgcctggccccagccccaggcagccacagcaggctgccttaccccagaagcagctggtggcgcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcaagcccgggccagggctgccagggagcaggccaccaccaacgcccgcatcctggcccgtgtcggccactgctgagcctgagagagggggtcacagtgatagggccaccctggatgggaagacctggagggcagccacacagctggacggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtgtgccccacagacctaatatatgtccggacagcttggatgctgccacgtaaggtcactgctgtggcgagtcttgctatgtctgggtgccccatagtcacagaacacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccaggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatatagcagacatggaggtcctgcagcaggaggtgctcaataaacacaaagcgactgaaggatggga

SEQ ID NO: 412848 - DNA, 491 bp, Homo sapiens
aactagtttcactgaaaatagaggtaaggcataggaatactatccacgttgttactactattcgaaaagaaaaacaatctaaaaaataattcaagacattttatgaatgtcctagctagtttccttagatgggagccttcctttctgtgattcaaggcttaattccctctcttcacacccatcacttcgcaatgcagttacaagaccataactctgatctgaccttttaccttctcatttcctgccagaaccacttcatcctgctcattcatcagtggtcaaagttaaatgctaagtcatttactttcagaggagaatcagaaagtatggaccagaggagctagtaaggaaggcatagtaagacagtagtagaaagtggtaacaggggcttttgagtagaacagacaaactgggattcttttcaagctgcctttgaccagccatgcaatgtagagcaagtaaaatcatgattaacaagaccccctcatata

SEQ ID NO: 412849 - DNA, 793 bp, Homo sapiens
tcccaagtagctgggattataggcacccaccaccacgcctggctaatatttatttatttatttattttgagatggagtttcactcttgttgcccaggctggagtgcagtggtgcagtctcagctcgccacaacctctgctgcccgggttcaagcgattctcctgcctcagcctcccgagtagctgggattacaggtatgcgccaccatgcccagctaattctgtatttttagtagagacggggtttcactatgttggccaggctggtctcaaactcctgacctcatgtgatctgcccacctcggcctcccaaagtgctgggattataggcgtgagccgctgggcaccgcgccgggctgagctttatttttctttcatgtaaaagtccaagtgagtggtccagggttgacagggaatcggggaccaggctcctttcagtctgctccctgctgtaatggtctctgttcccaaatctgcctcatggccccaggcggctgcaccagcttcggccattgtgtctttatctcatttaagaggcaggagagagggcagttgcctgccactgctgctctcactctgttggcctgaacgaagtcatcaggcacatccagtgccaggatgctcaggaaggcagcagttgctctgggcagccatgcgcccactaaaattcaggtgtttcatatctgaggaagaaggacagcagcgtaggctctgcctccagctagattccaagcctggcccccaagaacgagggggaggtaagcagaccacacccttagcaggacatcccagca

SEQ ID NO: 412850 - DNA, 736 bp, Homo sapiens
gggcatctgtgggtccggcatggccgcaggtgtcagtggatcgccctcatgtcgcccatcattcatggcgcccggaattcaagctgagtgtccatggcctcacctcggccgacgttacgtcatggagagttgtacaggtatgcgccaccatgcccagctaattctgtatttttagtagagacggggtttcactatgttggccaggctggtctcaaactcctgacctcatgtgatctgcccacctcggcctcccaaagtgctgggattataggcgtgagccgctgggcaccgcgccgggctgagctttatttttctttcatgtaaaagtccaagtgagtggtccagggttgacagggaatcggggaccaggctcctttcagtctgctccctgctgtaatggtctctgttcccaaatctgcctcatggccccaggcggctgcaccagcttcggccattgtgtctttatctcatttaagaggcaggagagagggcagttgcctgccactgctgctctcactctgttggcctgaacgaagtcatcaggcacatccagtgccaggatgctcaggaaggcagcagttgctctgggcagccatgcgcccactaaaattcaggtgtttcatatctgaggaagaaggacagcagcgtaggctctgcctccagctagattccaagcctggcccccaagaacgagggggaggtaagcagaccacacccttagcaggacatcccagca

SEQ ID NO: 412851 - DNA, 747 bp, Homo sapiens
gaattcaatgtttcttcctggaaacatttcagatttttaatattttatttgatttagactcactatatttggaaagctttaattgtaattttatttttaatagatatagagctattcggatttgctatttattcttgtgtcactgttaatgattttctagaaatgtatctatttcatcaaattatgtcaaaatttttgacttaaagttacttattacattctctttttctatcccatgactatagaatctataatgatttccttgttattattgatgatatttagaatttgtggatactctttttttttttaatttcacgcataatcatggtatatttttatcagtcttttcaaagtaactttggcttttgctgatttcatttattttatgattgtttccttttctcatgcttcttatgtatcttctcttttctaattctttggatttaatttgacatcacattttaaatttttgagattgacaattagattattaattttcaagctttaattttttaaacaagcatatgcatttatctccaagctgaggtttgcctaagcctcccatcttttaacaagcagtatttttactttcatttttattaaattcaaaatatattttaatattcattgtaattacttttttgatgcatgaataacttagaaatgtgatgcttaatttctaaacatttggttactttcaaagtcttgctatagatttgcagcttaataacattgttgtacaaa

SEQ ID NO: 412852 - DNA, 229 bp, Homo sapiens
cagttcttacatccattcccattaccttttgggactccattaacattcacgtgcactacggaaatggcttcctaaatgatacccatcactgtatcctcagggtcgaggaaaagcttagcagacactatgcctgccataagtaatttattgaataaatgcttaccatgctatactctatactgaagccagttatctttttaaaacagtctcctgatttatagtgttaagt

SEQ ID NO: 412853 - DNA, 543 bp, Homo sapiens
cttgctttggcccaattgaacaaacctttctctatctccaagcacctgtgtcttagcgtttggcttcagctctgcatcagtgtgtgtgtgtgcctgtgtcatggcaccctttgttagagaagagccccaacctcctagagaatagcaagaaataacaagactccaacggagacgactaagcaagaaagcaggttcaccagccacaactccattggtaccaatgtagatgagatttggtggatcagatgaagaaatttattattcaacacagcatacagtaggagtaccagcaagcaagattcctgaacacagacaataactgctcaataaatgtaaggatgaaagggcctgaaattgtgacaactacataagaaaactgtgtgtcatgatgctattaagggactgtattcattgaattccttctatatacaaggtccaggcatagatggatccatggaaaagcttaagatatcttcatcagtcaaggtctaatcagaagacaaaccatgctcatttgaataaagacagtttaatatatgagga

SEQ ID NO: 412854 - DNA, 367 bp, Homo sapiens
gccttgcaatacatttttggaaggtcagttcacatctgttttctatttgtcatattctgtcagcacttctgtgagaactgagccattacaccagccttggaagccagaggcagctggatccttcaggcctggcatctcccaggcccgcggtcctacctcagtggaggaagagtgggaactgctgtgcattccaacttcagttccctgtgtgtgccgctgccaccatcgctcacctgcaaactgcttcaaagagcaaacaggcactaagaattcagcctggtgaatccattgttctcctccccataaaacaacaaacaacttagaggcttttcaatcctctgatgtgtttaatttgttatctagcaac

SEQ ID NO: 412855 - DNA, 768 bp, Homo sapiens
gtgtggccctccctacctttctctaggtaaccatgggtggtccttactgcaggatcagtccctgaagtgaccagcagttacgatgcctgctgtgtgtgtgtgttgagatgggtgtgatttcagagcattgcctcacactgtggtatgtgacgctttcagatctgcacccctgctgcatcgtctcatgctttgtagggagctgctacacggagtcattgttgggaggtgccatcagagtctgcattaaagtgtgtgctttcaaaactgagacgaaaaggcagaagaactttgaaagtcctgattggttttcatttatggtaactaatgtacagtgtgtgattggtaatgtgaacatgtttatatagatatgtgactgagtcacagcattcttatgtgggaaagctacactttgcccctgttttccaaaagatgtgggacaaataaagcaataaaaaaaaaaaaaaaaaaaaaaaaaaaaaaaaaaaaaacccggggggcctttttgcggggggggggaaaaaggggtttaaaaggggccctggggcccaagggtgttccgaggcccccggttttttgtgcaccacgggggcgaaaaacgcggcgggcggcccacaatagaggggggcgccataaaactctcgacagcccgccggggtaacccctgtagagaggtcgcccaacaaccccccacagcactagtacaagacacaccatacaccgttcacagccacacccaccatgcccacaccatgccctaggtcaccaacc

SEQ ID NO: 412856 - DNA, 697 bp, Homo sapiens
tttagactcaactagaaaaccaattatattaatatcaatttatatatggagccatagttctatacagtggtattcattaaatgttcatttcagtctttgtcagctatttccttttaaaaaatttttctttttttactaatcaaaagagagctggagtaagtagctacccccttgaaaaatgttagccagctcatatttcaccgttgtttggtagttgtacagttaaaaaacttatttaaggtataattgaagtgttacaggcataataattttcttgggtacaatttctgtatttcattgtttcacattttgagcagccctaagttaaaactaaatgatattctaaattaatatagctaaggaagctcacctttcttaagatttctgtatttctctaccatttactacaggttcttatctctaccatttattaaaagttcttgattagagcacccaaaaataggctctaatttaatgtgactgtgtctgaggaagaatagaatccattttttccattgagtattacaaattgtaattaaagttgcagggcatatcgaaagtaatttgttttcccctcataacaaatgaccaatattagaaatcaatagtatttatttataaactataaattaaaagcatataacttttaaatttataattccaatgtggaattttaaaaacatatctcttatttctg

SEQ ID NO: 412857 - DNA, 588 bp, Homo sapiens
agatggaaatgcagaaatcacctgtcttctgcttcgctcacgctgggagctgtagaccggagctgttcctgttcggccatcttggctcctccctgccagatagctcttattttgagtttcaggtatgtctttatcagcagtgtgaaaatggactattataccaagtaaagaggaggtttcaagacaggaagaatcaagattaaatcatatgcagaacagtcttaacctaagaattaagaagctttgtgatttggtaacaagaagatcatcagtgaccttaagatctgaaagagagagtaacagtgcaatttgacataaacagctccttgcctatctggctgccccagccaagctgggtcctacacaagttgctataagagctttctacaacaagatctgaactactgaaagattcagatcacttgactttttaggtacagaaggaactgtgcgcatggtgagaccctctctggtcaacttctcagtacaggatcctcttaccccatcaacagtggggcactcccttccttctagccccttccttcacgtctatgtggtttagcctggttagtaacttggacgaacaga

SEQ ID NO: 412858 - DNA, 877 bp, Homo sapiens
  misc_feature (877)..(877): n is a, c, g, or t
gtcgcagaaccctagctgtaatcactaaacttgatctcatggatgcgggtactgatgccatggatgtattgatgggaagggttattccagtcaaacttggaataattggagtagttaacaggagccagctagatattaacaacaagaagagtgtaactgattcaatccgtgatgagtatgcttttcttcaaaagaaatatccatctctggccaatagaaatggaacaaagtatcttgctaggactctaaacaggttactgatgcatcacatcagagattgtttaccagagttgaaaacgagaataaatgttctagctgctcagtatcagtctcttctaaatagctacggtgaacccgtggatgataaaagtgctactttactccaacttattaccaaatttgccacagaatattgtaacactatcgaaggaactgcaacacatcatattgaaacttcggagctatgcggtggtgctagaattgttatattttgcatgagactttgggcgaacttagaatctgttgatcacttggtggccttaacactattgacattttgacgtgccattagaaatgctactggtcctcgtcctgctttattttgtgcctgaggtttatttgagttactggtgaaggggaaatcaaagttctagaagaagcagctccggtgtgttggcattgggtcatgaggaatggaaaggatcatcagagctggtagaatacaggaacaggattgtacgagattccgaattcagaatgcaacggaagggatggatttataaaagagatcgaacatagatggtcgagtaggataaatggatttaaaaaacaatagagatatgagatgaaataaaggaaaagaagaataggagaaagn

SEQ ID NO: 412859 - DNA, 463 bp, Homo sapiens
gctctggctttctgcctcccaggtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtcaacacattccagactgtgctcatcacagacggcaagctctccttcaccatcttcaactatgagtccatcgtgtggaccacaggcacacacgccagcagcgggggcaacgccactggcctcgggggcatcgcagcccaggtaggcgagtgc

SEQ ID NO: 412860 - DNA, 169 bp, Homo sapiens
ctgattattttcacaattttcctgagatgtcgttatcattctctgactctcttgtctattatcagacatttggctctcagaggtgactttctggctgaagaatgtggattcgtcactgtcttgtgctcaatgtagagggggctctgtaattccagaaatgtccatatct

SEQ ID NO: 412861 - DNA, 892 bp, Homo sapiens
tgttattattctgaatcttgggggaggttatatgggtttaatagtttttttaatttatttagggggaatgatggttgtctttggatatactacagcgatggctattgaggagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggatggacgtttcgctcttgttgcccaggctagagtgcaatcgtgcaatctcggctcaccacaacctttgcctcccgggttcaagcaattctcctgccacagcctctcgagtagttgggattacagcagaaccaaagccagaaatctacacttgttcctcctgccttctggccttctcctgtcagcagttcctcagtcaacatgtacttcagatcttcctg

SEQ ID NO: 412862 - DNA, 676 bp, Homo sapiens
ggcgtcggtcggtggccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggcagaaccaaagccagaaatctacacttgttcctcctgccttctggccttctcctgtcagcagttcctcagtcaacatgtacttcagatcttcctg

SEQ ID NO: 412863 - DNA, 874 bp, Homo sapiens
ggcgtcggtcggtggccgagatcccgggcacgctggctctggtgagcgcggcctccgcggctccttggccccaggatgccctctctcgtggggaaaggagggtcgggaaaggccgagcgtaggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaaaaatacaaaaattagctgagcatggtggcatgtgcctgtaatctcagctacttgggagcctgaggcaggagaatcacttgaaccagggagtcagaggttgcagtgagccgagattgtgccgttgcactccagcctggtgacagagtgaaactcagtctg

SEQ ID NO: 412864 - DNA, 803 bp, Homo sapiens
ggcacgaggcctcgtgccgattcggcacgaggcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattgggtcaggagatcgagaccatcctggccaacatagtgaaatcccatctctactaaaaatacaaaaattagctgagcatggtggcatgtgcctgtaatctcagctacttgggagcctgaggcaggagaatcacttgaaccagggagtcagaggttgcagtgagccgagattgtgccgttgcactccagcctggtgacagagtgaaactcagtctg

SEQ ID NO: 412865 - DNA, 839 bp, Homo sapiens
ggcgtcggtcggtggccgagatcccgggcacgctggctctggtccaccttctccaatccctgcctgctgggagaggacgatctcttgagaaaggaaagacttctgtgctcccgagaacttcctatcaggtcctggctgcagggaaacaagctgggctttttataattaaggttggaagaagtcaccacaggcagcagaactccatcttgagatgaaataacatctacctggacctctggcagaatttcaaggcacacactgggctgactctggcgccatgatgttgccttatccttcagcactgggagatcaatactgggaagagattttgcttccaaagaatggggaaaatgtagagactatgaagaaattgacccaaaatcataaagcgaaaggcttgccttctaatgatactgactgcccccagaaaaaggagggaaaggcccaaatagtggtaccagttacattcagggatgtgactgtgatcttcacagaagcagaatggaagagactgagtccagagcagaggaatctatacaaagaagtgatgctggagaattacaggaatcttctctcattggacggtgggcaagagcagcaagatgctgcagcatattgattacaggatgaggtgcatcctgcaggacggccggatcttcattggcaccttcaaggcttttgacaagcacatgaatttgatcctctgtgactgtgatgagttcagaaagatcaagtgtgtgaggggggagagcttgagtttctggcctcattgcctatttgtaaagctgtagcctaaagggctctcccaatgcagcctggtctgaaactgctttaagaag

SEQ ID NO: 412866 - DNA, 327 bp, Homo sapiens
caatactacttaacattcccaactttatatatgattttccaaatttaccttctttccaaaagaaaaccatacctatgtttctcatactcgtaatgtgtcttttaacactattaatatacaaattttttaaagaaccccctttttctttaagaggtaaggttttgctctctcacccaggctggagtgcagtagtgagatcatagctcactgtaacctctaactcctgggctcaagcagtcctcctgcctcagcctcctgattagctgagactacaggcgtgtgcccccatgcccagctaattttttgtatgtttttgtagagatgggg

SEQ ID NO: 412867 - DNA, 149 bp, Homo sapiens
aaccttctaaaagcttcttattgtatttttttaaaaatgctcgcgttcttaccatggcttacaagaccctacaagatctggcctctgcctatctcttaaaccttgtctcctgccaccttccccctcactcccgccatgatggcctcctt

SEQ ID NO: 412868 - DNA, 192 bp, Homo sapiens
  misc_feature (1)..(2): n is a, c, g, or t
  misc_feature (6)..(6): n is a, c, g, or t
nngggncgcatgtgtaatttactgttttcccaaaggaaaagtcttccagaggttttcctgtgtgtggcccattaggaataactggaggacttggacaaaagatttgttcacacactggaacactgctattccaaaggctttccattccagccaaaacacagtaactagcagagctgccttttaattgaaatc

SEQ ID NO: 412869 - DNA, 636 bp, Homo sapiens
tacacaacctgtcttttccacaggctaagttcagtgggccccgagctattcaaaactcaacacttttgcaataaaaataaaagttcctttagtaccttccacgttaccaagcccatttagagttctgatctcctttggcttcaacaacaaccctgggaggtattcctgggagaacacagaggtctcccagtcttcaaagctacacacttcacttgtcagacactaaaattcctcactctttggtgagtcatttgcatttctaaagtgagtttcctttcagaatagctgggctgaaatgtggttgtaagtgactgggcattagagctggcagaacacaacagagactgtatgcactttcaactccagactcttccacgacctctttctacctctcagacgaggtagtgcctggctgcaatttttcaagaaccaaaacttgaatgactgccatcattaggctctaaagtcaaaaattggcctgaattctccccccaaagaaataagcacctaatatttttcttcgtatgctgaaaattcagggaagctctgataacacaaccatttagcgttacatgcaagaaatgcttccacttaaggtcaagagtttggcatctgcttcctgaagccccttctgaa

SEQ ID NO: 412870 - DNA, 581 bp, Homo sapiens
cacgaccatgcccagctatttttgtatttttagtagagaaggggtttcaccatgttggccaggctggtctcgaactcctgacctcaggtggtcctcctgcctcggcctcccaaagtgctagaattacaggcatgagccaccaacgcccagccttgactattgtcttaagatagggtgaaattacaggatcaaatgatttggacagttttgcaagtcttaatgcattttaaattaaaatgctttttaaaaaagctgggacagccaggtgcggtggctcatgcatgtaatctcaactcaggaggctgaggcaggagaattgcttgaacctgggaggcagaggttgtggtgagctgagatcgcaccactgcactccagcctgggcaacaagagcaaaacttcgtcttaaaaacaaacaaaaaaagctgggacagtttacaatgggcaatagccatgtaccagctttaccacaccttcacctgccctggtttttttgttgtgtttttcaattgttgttattgatttaagtgaaagaattttttttttttttttattgatcattcttgggtgtttctcgcagaggg

SEQ ID NO: 412871 - DNA, 736 bp, Homo sapiens
catgaaattctctcctttaaggtgcaaaattcagtggtttttagtgtatttacaaagttgtgcaactatctccactctctaagtatggcacattttaactattccgaaaagaatccccatgcccagtagcagtctgtcgctatctttccttccctcagcctctggcagccactaatctagttcagtctgtatgaattcgcttattctggagttttccttttcttctttttttgagatagagtctcactcttttgcccaggttggagtgcagtgacgtgataatacctcactgcagccttgacctcctaggcttgaacgaattttcagcctcggcctcccagagtgctgggattacaggcgtgggccattgcgcccaaccctcttggctcttttgtaccttgttccctagtggtttgcttacacgaaatcctacctgatggtaatatagatttccttctaacattttataggaaaatttcaatataccaaaaaattgaattgtacagtgaacacctgtctatccaccacttatcttctggattaacagttttctatatgtgctttatcacatacctgtgatggtatactcatttttaattaatccatatttgtgtatttaatgggaattggtagcagccgaagcaaactctcttggagtgacaaaatctgtgcagaggagaaataacctgtttattttacttatgatttgtaagaaagggcagaactattttctttt

SEQ ID NO: 412872 - DNA, 681 bp, Homo sapiens
actgactgtcttttatgattaagcaacaactgtcaatccctattgcattcactatttatgaagcccaagcatgagctgggtgtttctgctccttcagaattataggacattgtccttaaagttccacaccaggccaaggaatctgagaattcctgggggacttacatgtttgtggtcacctttggctctaaccttctggttccctgtattttagtttttgcattatcatttgtcgtttgtgtattctttttgttctctgtcacttagccctggctgtgatctcaggtttccttaatttctatgtattaaaaaaaatcttacataaagcagttgcatatatggtagacttgactgaagagggagaaagggagggctttatattgtagcaacaaaaataatttcaaattgaaaatcatatatccttgttcttaaaagtcctttggccaccttgctactgggaagagaatttgaccattaatcccaacatagtaccccagccatgcattatctgcctactttctttgaattttacttgtttcttttctctcttctgttcttctttctattcatgtttatatgaaaggcagagctgtttggctaatcgctactcttgggtaggatctcaccttcctacttgcctctactcaggtagcttatatgtggggtgtgtatgtgtgtgtg

SEQ ID NO: 412873 - DNA, 746 bp, Homo sapiens
tcctcctgtgaatcaagaatatttttaatgacatctagaatggtgaatcctttccagaaggctttcagtttactttacccagattaatcagaggaatcactatggcaactgtagcctttgaagtatatttcttaataataagacttgaaagtccaaattactccttgacccatgggctgcagaatggatgttgtattagcaggcataaaaacattaatctggctaggcatggtttggctcacgcctgtaatcctagcactttgggaggcagaggcgggcggatcagttgaggtcagaagttggagaccagcctgaccaacatggtgaaaccctgtctctactaaaaatataaaaattagccgggtgtggtggtgggtgcctggaatcccagctacttgggagactgaggcaggagaattgcttgaacttgggaggtggaggttgtagtgagctgagatcatgccattgcactccagcctaggcaacggagcaagactccgtctcaaaacaaaacaaaacaaaaaacattattctgatgtaatgaaaaatacctgtcaaatcgaattaagaaaagacaatgagtaaagagaactgttatgattttaaaaatacgttacccacaatcactttggaactcaaaatagtttcctgggaggatgaatgatcataatttattcaaagagataaaatactagaactggctaataagaaatgaatgtaaaaaccacggaagttgtacttttaaa

SEQ ID NO: 412874 - DNA, 793 bp, Homo sapiens
tgattctttaaatgcttctccatccagttcttcagagagctactatcaacagattgagttgacaggaaaaagtcataatccaggccaaagtgagcaaactcccaagagcattcctggtcagcaccgcagcaaatccgtggcaagtgcagagattataagcaatttctctatggctggaattcagttgatctgggactgaacctatttctaatggagtctcagcagacacagatctaggcagacatcaggtggacagaatctaagtctgccgagtgcctgcgattgcaggcgcgcgccgccacgcctgactggttttcgtatttttttggtggagacggggtttcgctgtgttggccgggctggtctccagctcctaactgcgagtgatccgccagcctcggcctccggaggtgccgggattgcagacagtgtctggttcactcagtgctcaatggtgcccaggctggagtgcagtggcgtgatctcggctcgctacaacctccacctcccagccgcctgccttggcctcccaaagtgcccagagtgcagcctctgcctggccgccaccccgtctaggaagtgaggagcgtctctgcctggccgcccattgtctgggatgtgaggagcccctctgcctggctgcccagtctggaaagtgaggagtgtctctgcccggccgccatcccatctaggaagtgaggagcgcctcttcccggccgccatcccatctaggaagtgaggagcgtctctgcccggccgcccatcgtctgagatgtggggagcgcctttgccc

SEQ ID NO: 412875 - DNA, 729 bp, Homo sapiens
aaggcatgtatgtatgttatgtaaacggtcattttgccatgcctaaatgtttctatctctagaattgtgaaaacattacgactgtcaatacgttgttggtttcctgaattacactgctgccacttgactatataactggctagtttttgaaatgttttaaattttggattcagggaacacatgtgcaggtttgttacctgggtatattgcatgatgctcaagtttggagtatagatggtcccatcacccagatagtgagcatagtacccaataggtagtttttcagcacataacctcctcctttactctccccctctagtagtccccagtgtctgttgttctcatctttatgtatatttgttttcaatgtttagctcctacttacgagtgagaccatgttgctgcaaaggacatgatttcattcttttttatggctgtgtagtatttcatggttcatggtgtatatgtgccacattttccttatccctgacaccattgatgggcatctgggttaattttacatctttgctattgtgaatagtgctgctatgaacatatgaatgcatatggctctttgatagaatgatttatttttttgagacaagagtcttactctgtcgcccaggctggagtgcagtggcatgatctcggcttactgccatcttcgccttacaggttcaagtgattctcatgcctcagcctcctgagtagttgagattataggcatgc

SEQ ID NO: 412876 - DNA, 650 bp, Homo sapiens
aaaattacatattacatttaaacctctcaatatatttttcgtagtatacatgggttgcacggtaatttttcaagttacaagtgtttgatcacaaactataacttactatggttcttatgctctgaaagaaatatgtgtaggaggacttgagggagggtgttaggaaacttacctgaggaattgatctttcacctaaaaattgaaggatgtgtgggaatgtcttaggcactgggactgtaagtgcaaagaccctgtggcacaagggaatgttaattatctacctttcagaaactggaagaaggcctagcctagagcattgaaaacaataagggaaaggaggagtaaggctggagagagaggaatggtttaaagtctttgttaaaaatttttttaaaaaaatctttatcacaagaagaggattggcatgatcaaatttgacttttaaaaagattacttgggttgggcatgatcaaatactacttagggagattagtttagatgataatggcattctggaccagagtggagtcagaggtgaaaagaggtagatattccagaattgagggatttgtgaggtgaaatcatttgttacagatattaaaggataaggagctttgtcaaaggggatcttaagtttctggtatggtaac

SEQ ID NO: 412877 - DNA, 673 bp, Homo sapiens
tagctgggattacaggcgccggccaccttgcctggctaatttttgtatttttagtagagacgaggtttcaccatgttggccaggctggtcttgaactcctgacctcaagtgatccacctgcctcggcttcccaaagtgctggcattacaggctcgctcaggcatcttgccttgtaattctcatgatagtaatggctatttttttcttgccttagagttgtaagtaaaaattccttaattacacattaaggtttgatctttaattttacaatgtttgagtcattttgttacttcttttctcccagaatgacttgcgtagctctaaatgattttagttaatttcacatctgtttgcctttcttctaaaatgacccctagaatctcagcttaacgcaaaaaattctcttaaagttatacttgctcacaaaaatgttaactttataaatgtagaacactctcctactaatttcaattttgtttgtttctttttttgttttttttgagacggagtttcgttcttgttgcccaggctggagtgcagtggcatgatctttcctcaccacagcctctgcctcctgggttcaagcgattctcctgcctcagcctcctgagtagctgggattacaggcatgcgccaccacacctggctaattttgtatttttagtagagacag

SEQ ID NO: 412878 - DNA, 117 bp, Homo sapiens
gttactattaaaaccgtttcttaaggtcttaattctcaaatcacttgcagccttccagtgcagttttaaatttcctatgagcatcatttggcttccaaagtggaaaaaaaaaggaaa

SEQ ID NO: 412879 - DNA, 325 bp, Homo sapiens
gcactccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgagcagccattgtttgatgtcctgtgactgagaaaccaggctttaa

SEQ ID NO: 412880 - DNA, 556 bp, Homo sapiens
gcactccgcctgcagcccagctgccagcgccgtctcccgcggccgccgccgcccgacagcgcgcccggaacatgccagcctcgcgcagcctgcgctgacttccccgagacgcgccgcggtcggcacggagactttctgggctctggatggttcgtgcgctgctcaccctcgcccacccctgacgccgcggaccgcagctcctcagccccgcagccccgcagcccagcagccccgcagcggcgccgaggacagtgcagccgagttgcgtctccctcgcgcgaggtgagtggcagcctggatcccggcggattccgcagagggggctgcggcgcggtggtggggggcgagcgccgcaggggtagggccgggcaccttcgctggcaccgccggagtctgtgacacccagactgggtcggtgtcgcagaagatcagggagaaggtcataatcggtttgttgggctgtgtagacagggaaagcagatattggctgcagcatcgccagggctccgcagaggctctccgcatggctcctgtttgctgcatcacaaccaactct

SEQ ID NO: 412881 - DNA, 337 bp, Homo sapiens
tgtacctgtgtggaggaaaagtactgagtgaagggcagaaaaagagaaaacagaaatgctctgcccttggagaactgctaacctagggctactgttgattttgactatcttcttagtggccgaagcggagggtgctgctcaaccaaacaactcattaatgctgcaaactagcaaggagaatcatgctttagcttcaagcagtttatgtatggatgaaaaacagattacacagaactactcgaaagtactcgcagaagttaacacttcatggcctgtaaagatggctacaaatgctgtgctttgttgccctcctatcgcattaagaaatttgatcata

SEQ ID NO: 412882 - DNA, 678 bp, Homo sapiens
cgcatgatgatggcagtggatcagagtcccaaggacactggtgaagatcagagcaggactcacacaacctcagatccctgtggagtcagggtggaaccagagggaaggctgaaggctggagggtcctgagaggccttgcagaaagagaggacattggagctggggctttgatggatgaagaggaactagggaaaggcatttcaagcagagggaacagcctgtgcaaccacagcaggcagcccagcatgccagtgcttcctccatgaatttgaaagacatattggctgacctcatacctaaggagcaggccagaattaagaccttcaggcagcaacatggcaagaaggtggtgggccaaatcactgtggacatgatgtatggtggcatgagaggcatgaagggattggtctatgaaacatcagttcttgatcctgatgagggcatccgtttctgaggctttagtatccctgaatgccagaaactgctacccaaggctaagggtggggaagaacccctgcctgagggcttatattggctgctggtaactggatgtatcccaacagaggaacaggtatcttggctctcaaaagagtgggcaaagagggcagctctgccttcccatgtggtcaccatgctggacaactttcccaccaatctacaccccatgtctcagctcag

SEQ ID NO: 412883 - DNA, 435 bp, Homo sapiens
cgactcagaaccggacggaatcgagagatcttggcccgtcctccgtgccactcttttgagggtagactacatttcccagaaggttcagcggtttgagtcagcttttcgcgcgaacttttcctccgccagagcttgtgggactgtctccctggccggggcaggggtgtaaagatggacacctgcatgagggaaggaatatgtgagcagcttccatttcccttccatggtcttctcagcttcctccaacagtagattgttcagcctccctaaagcaggagaagaggaaggggaagaaaggtgtttttccgggtttctaagcaaataccttgctgcagatcttcaactgcaggggagggcatgttgccagaacatcctgtttacagaggccacttaaaatccttacgttaaccctaggcatactgtggtcatcctttt

SEQ ID NO: 412884 - DNA, 828 bp, Homo sapiens
  misc_feature (326)..(326): n is a, c, g, or t
ggtttgtgtggttgtctgtcgtcggttgtgtggtctggctttggtgtcgctgtggtgtgggtgtcgtgtgtgttggtgtggttgggttggtcgttcgtgtgggcccggggggcgtatgacgctggccctttggaccgggccccggcccttgggtgtctcgacgccgggtccccgccgtttttttgggggggaacgcgcgcgtggctcgccgaggtgttccttggcccggccgtggcgcgtgtcgtcgcttgtgggcggcgcccccagggatgggtttaaaaatttttcgggcgaggccccaaaaagttttttttgggttttttttnttatgtgggggatggagtccagctgtgtcacccaggctagagtgtagtggtgcaatctcagctcactgcaacctccgcctcccaggttcaatcagttctcctgcctcagcctcccgagtagctgggactacaggcgcgcgccactactcccggctaattgttcaatatttttgtggaaacagggatcttgctatgttcctatggtggtcttgagctccttagcctcctaaagtgttggtatcacaggcgtgagccactgtgcccggcgttaacaatcttctgccccagggtcggccacagttggacaggagcaccctgcctcccctgtagcattcgtccccgtgcccggagttaactcctggacgacgtacacctgctgcactgctggatatagccattcttcatttttccctcctccacccaccatgtacaccccatcagcaagtcccatccgatatacccactacatacatctgccagctgttcccatctccacccacac

SEQ ID NO: 412885 - DNA, 474 bp, Homo sapiens
actgcctggggctggactcctgtagggaattccagaggacccagtctcacctgtttgggatgaagagacactattgtctctgcaggaaacaggaattactggggggaaacattagcagtctgcctttcaaacaggcacataattataatgacggcagaaactcagcgcacaggataagctaaattcaccccttcaacgtaagctcatgggtagctattatgtttagactctgtgatccgtacttagggaaccctgtactcccaaaggagctcacagacccagacctggcagggacatgcttaggaaaagatggtgtcaacagacccacaacacagaaccacactgtggggtggggaagcagagaggcgggaccagccacttccagcaggaagtttccaacctggactgggttgggacggtgaggggatagtcatctgccatcagtttacataggtgagccccttgacttacaac

SEQ ID NO: 412886 - DNA, 296 bp, Homo sapiens
gaggcaggacagatggaaatatatcaggaatagcatggaagataatattccgcatcacctgcactctgattcactctgtttaatggagacttttaaaaataaatcgcttttgaaagattaggttgaaatgtaatcagtgtagtgtctcatcagtcattactgaacttttaatgctaatgattttactgtgagataacctgtaatctttagtcatttatgaatgtctatttaccaatgattcagcaaccatacaggccacctttcagcgtgtctttgaaagggttctaggaacacag

SEQ ID NO: 412887 - DNA, 155 bp, Homo sapiens
ccttttcattgcaatgcagctactctcttctgcctcttactttgccttgtctttctgggtcttcttgttgtactggcagctataggcctgttcttttcattgtcgtggtgacattggaaaatttgggttgtagggcaagtgttggggactgctcc

SEQ ID NO: 412888 - DNA, 548 bp, Homo sapiens
acagaatcgctatgagaggaaaagtaaccattctagctttttctctggtaaaagaggttcacaaacggcagatcgctgttatgaaaaggaggggtggaagtatttaaggaatcgtggcaaacaaagtcacacaagaacagaaataaagcaaaaactacaaagtcattttaaggcttgttttacaaaacgttaggtggaatatcaattggtaaacccttatttagcatctgagtgtttggcattgtgtcgaggggaaagacagctatgtgagaaagccacaagttctaagtaaatgaatatgagagttatacaagggacaccaagtttaactacataggaattatgagaaagaagacaatatcagaaaaggctttttattggaatccaagaagactttaacacaaatatgtaagaactatgacaatagtcacattgcttacctgggtccactcagtcagttttctagatactacatggagggtccatttattttttgtttgtttgtttttaaaggcaaaccaaggtgaggggaggagcatggttgaacc

SEQ ID NO: 412889 - DNA, 754 bp, Homo sapiens
cagtatgatagctcatgtaaagcatttagcaaaatactactaatagctgccaaaattctgagagctgtaacacaaatacacatagaattaaggcacagaagaccctacactactatacccgatgttacacagtcgatgaaattcaaatgccgatttctcacttgtgtctgtgcactatgagcaacctatttaccattttcactgtatctctaatattcaaaattccagaaaaaggctttccacagtaccttcacactgatgatgaaaattagaaactacaaaatgcatagccttattaataaaacacctcaaccaattttatcccaacacaccaccacaagaacagaaataaagcaaaaactacaaagtcattttaaggcttgttttacaaaacgttaggtggaatatcaattggtaaacccttatttagcatctgagtgtttggcattgtgtcgaggggaaagacagctatgtgagaaagccacaagttctaagtaaatgaatatgagagttatacaagggacaccaagtttaactacataggaattatgagaaagaagacaatatcagaaaaggctttttattggaatccaagaagactttaacacaaatatgtaagaactatgacaatagtcacattgcttacctgggtccactcagtcagttttctagatactacatggagggtccatttattttttgtttgtttgtttttaaaggcaaaccaaggtgaggggaggagcatggttgaacc

SEQ ID NO: 412890 - DNA, 399 bp, Homo sapiens
ccccattcactgtcactgtttgtctgtgcaggcatttaagcaaagatcaacagacttgtatgattacaagagtgtactacttctaactgtattcagattcctctctagttttgcttaattcatattcatttattgctaagtctcaatagtcattaagagttactgatctgttctgaaaataattcttcagattagtcaatttttaaacaggttttctcaatctatcattaatgtgtatcaaatatcttcctaactcatcagcaatagttccttctctatcttacgtcatacaaataaataggcaattcatctctattctatgctaatggcacatggagacagcactgataagcaattcacaaagaggacatccaaaccacatttctcaactaaaaagac

SEQ ID NO: 412891 - DNA, 252 bp, Homo sapiens
cagccatatggccttatgttgttcctagctctgagcacagagccaagaaattatccccccatgcatatctttccattgaatctcccatgtcttcattcattaacaatcctgtcttaatttaccctttctgcagcatgagagactgtgccaaatgccacacaatgtcttaaggacacagaaccaacagcagaggcactttatagggaggtagatggtgacagatacgtaaactgggaacatcagaaaatggtg

SEQ ID NO: 412892 - DNA, 273 bp, Homo sapiens
ttagttttaatgatttagattttttcaataaatatttcagtttttcttatagcaggcttcaccaataacctagatattgccaatgaaaatctttttactcttagtaaaatttgaatatgtatctcaacattaacacacttttcagaaatgaagtcatttaagatcttttattgaattcctacttttcataagaactatttttatagcagtttcttggccttaatgagcagtagcattttgacgtgatgagtagcagaattttaatggtacgtt

SEQ ID NO: 412893 - DNA, 334 bp, Homo sapiens
ctgatggtcgactcctagaggtatcccccaggtagacctaacacagtaaaaataaatactattctgtttgttcttgaaactaaaaataccaagttaatatttacttgcaaaggtctttgaaatttatctgagatactttttagatctgttggtcaaatttctcaatatacatgcattcctcaaactacctttattcatattctgtctgtcatgttccatttgaaaagaaagaatgcttgaacagtacttgagatagctttacgcagtagaacaagtactgaactaagatgcagatctcaatggctatatgaaatcgtggggttaggtctacctg

SEQ ID NO: 412894 - DNA, 543 bp, Homo sapiens
agagaacaacctctaggagttgagagcagtccctggctgataccaagaaaacaagacttcagttctaaagctgcagaggaatgaaatctgccaataaaaggaatgatcttggaagaggactatgagctccagtttttcttccagctctcatggaaacaagcactgccacagccccttgatgagccagcagagtccagtcatctggcaacaatgacaggtatctggcatctgagaggaatatcaactgaagacaatgagagaattaaaaaagaagtaaacacaagacaatcttttttcacccccttagattctgcatttccacttgcttgattcagtaattgttttgttttgaatgttgtgtaaatgaatgctacagccctatgcaatttttaaaccactttgctgtgtgtctcatatggagctcaacaatgttactgctggcatgagtgcaccataaagcatatgactccctgatgtaacattttaaataaggatacatttctcatccaatgtgacattatgcaggaaaatttcacttcgtca

SEQ ID NO: 412895 - DNA, 298 bp, Homo sapiens
tttgggagatggtaccatagaagagtggctgttacagaattataagtagtttaattaaagtgtagagcatgaaatgagtttttttcctggatttctctggtaatcaatccattattccacagttggatggaaccatggtcagcaaagggagaaagctttagtggtcatgaaaagaaaatttggtgatacttttcttttaatagaatgtttacaagtaaagtcaggcattaatagtttgtgttctagacctctacacaaaaatttcagaaataacttgcttgaatcttttattttttag

SEQ ID NO: 412896 - DNA, 298 bp, Homo sapiens
gtaaactggcactttgtttagctcttatcaatttctaccacttcttacctcatctatctagtgtttcactctttgtcatttccacggtaaattctataattcagcaatcaagaaaataggaaggagtggaaggagaaaaaaggagtggaccctaaactgagacctgtagggagaggtgaatttttgtggacccttttgctgtggccatttttttgccaagcagtaattcattcctatcattatgcatatccttatataatatataaaagtatctaaatggaagaccaatatgctttat

SEQ ID NO: 412897 - DNA, 159 bp, Homo sapiens
catgtctctcttgaagcatacttcaccccactgtacttcgcaacacttctcatttttctcccatctctctggcctttccttgaatgaatgctaactgttcatcagggttcagtcctaggctctcttattttctcttgatatattttctacttaggtgct

SEQ ID NO: 412898 - DNA, 576 bp, Homo sapiens
actctgctaggtaccattggaaccaatgagccatgctccccaaatgtgaagcaccacatctcctccaagataaggcagaggactgtctcgcacacaagctatcaggtggctgctctgcctcccaggctggtgttgccctcgttcccacatgtgcagccttcacatcacagctcagaactggagctcacggtgggatttgcttggtgattagttggagaatgtgtactgaaaatatccactccataatgtggataaaacctaatctgtattcactggatgtctatgaaagacagcacagaccaatcattgatgcatctgagaaaatacaaagagctataaagaggaaagtgttagcagtggaagaggcaggcggagggtggcacagtcgtgggacactcaaatccgcatggcaaatgcctagccccattagtcaccatgaccgggtctctatggaaacgcctggaagatggtcctcaaaatagacagtcagggagcatgctgggtttctgcagcaggcacagaaaggtccagccctacctcctgctcttcccacctggaggatgggagcagcacacc

SEQ ID NO: 412899 - DNA, 455 bp, Homo sapiens
aatcgagctcggcacccattgaaaccaatgtgcagccttcacatcacagctcagaactggagctcacggtgggatttgcttggtgattagttggagaatgtgtactgaaaatatccactccataatgtggataaaacctaatctgtattcactggatgtctatgaaagacagcacagaccaatcattgatgcatctgagaaaatacaaagagctataaagaggaaagtgttagcagtggaagaggcaggcggagggtggcacagtcgtgggacactcaaatccgcatggcaaatgcctagccccattagtcaccatgaccgggtctctatggaaacgcctggaagatggtcctcaaaatagacagtcagggagcatgctgggtttctgcagcaggcacagaaaggtccagccctacctcctgctcttcccacctggaggatgggagcagcacacc

SEQ ID NO: 412900 - DNA, 1469 bp, Homo sapiens
ggcagggggcagaaacaggcagcatggagagtcctggaggatgaggcctctagggacgtgtgcataggacgccagcctgcctcagtgccgctgtagagaaggagggggagagctggattcatctagggcttggcagcggccaggaaggagcatggaaagatcaggaggcgagggaccttgcgatattggtgagagtgtggtaggtggtagactgtggaagctgaacatggagggtgggaaggacaaggttgatggacaggcatcctgaggagctggcgagcaggctcagtgcccggggcctggagtgactgagcaagaacaagggggtggggtctgcaaggggatgtgagagcccgtgattctggagggagggccatccccagtactggcagcctccagggcatgaccacagctgtgcaggggaggagaaagtcctggagatgaggggctctggggccagtgggtcaaggggctgctgaagtccccatggcagggggtggtgacagaacttgaagaggaaacctgtgcattgcagcagagtcctcggtgggcgtggagtctggacacatcactggacacaaggagacacgtgtctgcctcctaattcccaaagaagctgttgagtgagggcacctctgttggtgggtactttttctccacgccaggggctgttggccttcatgttcggcctcctgttggtgattacctgtggcactggcaaagagactgtttccaggcaggcacaggtgaaggctgccttatgccaaaagggccactggggccactcttcctcggaagagcagaaccgtgggcacagcagatgtgaagcagttctccatatgtggctgtgtgtgcgggtggcagtgggatggccacgtgcttgtgtgtatgtgatatcgtgtatgttttgtgtgagacagcatatgtgtgggagagacctcgtgtgagagatgcagtgtcagaactctaagacattgtgtgtgagagtgtgtgtcagatgccatgtgtgagacaccaagacacgggtatgtgatactctgtgtatatgtgagtctgtgtgagagacactgatactccaagacattgtgtgtgtgtgacactgtgagacaccaagacagtatatgtgcgagacagcctatgtatgtgacagtgtgtgtgtgagacaccatgagagactgtgtatttactgtgagagactgtgtgagagacacgtgtgagacactgtgtatatgacactatgtatacgtgagactgtgagacactatgtgtatgtgacactgtatatgtgtgagaccgtatgagacagtgtatatgacactgtatatgtgtgagactgtgtgtgtgaaacactatatgacactgtatatgtgtgacactgtatatgacactatatgtggagactatgtgtgagacactatgtatatgtgacactatgtatgtgtgtgacactgtgagagacactgtgagac

SEQ ID NO: 412901 - DNA, 533 bp, Homo sapiens
ttgcgtctcaggcctctcatgcatcttacttaattctctcagttccccaggaggcaggacataacattatcttccgtgtagaccagtgggtatgtgatactctgtgtatatgtgagtctgtgtgagagacactgatactccaagacattgtgtgtgtgtgacactgtgagacaccaagacagtatatgtgcgagacagcctatgtatgtgacagtgtgtgtgtgagacaccatgagagactgtgtatttactgtgagagactgtgtgagagacacgtgtgagacactgtgtatatgacactatgtatacgtgagactgtgagacactatgtgtatgtgacactgtatatgtgtgagaccgtatgagacagtgtatatgacactgtatatgtgtgagactgtgtgtgtgaaacactatatgacactgtatatgtgtgacactgtatatgacactatatgtggagactatgtgtgagacactatgtatatgtgacactatgtatgtgtgtgacactgtgagagacactgtgagac

SEQ ID NO: 412902 - DNA, 421 bp, Homo sapiens
ggagctcgcgacccccaacgctgctcacatcatagtccatgtgtgttgagttttaagctgaagttgagcagtggttactagagtttggggtttcattgtaggtcctcttcacatatgtatattctccaggtcaagacacttttaacattgagaatgcagaaaggctgtaaaggatactcattcctaaaaaggtcacatggctgggtgtcccttaagttgtatacatggtcattattttttctatttctctgtgcatcagtaagacattgttctggaaatacttgtaaaccactggtttagggataaatccatctttgggagccaaaacttggatgtggaccattttccacactgttgagatcctggtagatgcgtgagcatctgcagcctgataatttgatattttcactctggcttcaca

SEQ ID NO: 412903 - DNA, 227 bp, Homo sapiens
ctaagccagagttctcaaggtaaaaaaaccttcatttttccttaccactcctcacatctggctgactggcccatcacattattttcctagttaatgtggaaactggccccttggcttggtgtagatgacagtgcaccagatgattggtaaaatgtagagtgaatgcagagttgtcaggtctttaacaatgcctctgtggggggctactatccaatctgtagacccaa

SEQ ID NO: 412904 - DNA, 841 bp, Homo sapiens
acttctgggcgtcgctgctgctgcgcgccggggacaaggcggggcgcgcgggcgcggggatgcccccctaccaccggcgagtcggcatggtccaggagctgctgcggatggtgcgccagggccggcgggaggaggcggggacgctgctgcagcacctgcgccaggacctgggcatggagtcgacctcgctagacgacgttctgtatcgctacgccagcttccggaacctggtggaccccatcacacacgacctcatcatcagcctggcacgctacatccactgtcccaagccggaaggcgatgcactgggcgccatggagaagctgtgccggcagctgacataccacctcagcccccactcccagtggaggcggcaccgggggctggtgaaaaggaagccacaggcctgcctcaaggctgtcctggccggaagccccccagacaacacagtggacctgtcgggaatcccactgacctcccgagacctggagcgggtgaccagctacctacagcgctgtggggagcaggtagacagcgtggagctgggcttcacaggcctcacggacgacatggtcctgcagctgctgccagcactcagcaccctgccccgcctcaccacactggcactcaatggcaacggttgacccgggccgtgctgcgcgacctcactgacatccttaaggatcccagcaagttccccaatgtcacgtggattgacctgggcaacaacgtggacatcttctccttgccccagcccttcctgctcagcctgcgcaagcgctccccaaagcagggccacctacccaccatcctggagctgggtgagggcccaggcagtggg

SEQ ID NO: 412905 - DNA, 1327 bp, Homo sapiens
tgagtagggggcctgcagtgtgctgtgacgcctgggaaggggattctaagccatttcccatcagccatttactaagtagcctggggatcttgttaaaatgcagatcctgatagattagggctggggtgctgcccaagattctacatttctaagagtccctggatgacggtggcattcacagaccacagcttctatgtgagggagagcagttgggtttctgtctgcctgccgcacctgatcagtagttagtgcctgcatgtgtggcggccagaattttacttggggagacgctcggctcctagcaccctctgtggtaggggttttccagagtgtgggcattaccccaactgtctctgcagacggcttcctgcatgtttcccacaagcgctcagatggctgaattggcaagtctgtggtgctgctctttggggccacctcgttctttgcctttccctccccttagcgatgtgtcccatccgttgcctacagtcaagtcagtccacatgtttaggctaaggtgggcatgaccgagtggccttcccccgggaagaccagtgtcgtaactggaattaagttgtggaacataagagtcaaggctcgtgtctgctgtgaactggagttgagggaatgtttggggatcccacctggtatcagtaagggaaccatggcgacggccagccttgcccatgtgaggcatttgctttgtcaggccttctcagtagtggagaagggaggaaggagaatgcagctctttcagtgctgtctagcagtgcccaagagccgtgattgggcacctcacttaacgtctaacttcagattcactcttgggcattcctgtcttcctctccaatcttgaatggatgttggcttcgataatgtcatcctgaagtttctttgtccacacagccctggctggttgttaataagctgttaatgcagccttgcactcaggaagccctgatgtttaaaggaactgtgtctttgttcttcctctcttccctctttctcttagtcccactttatctcttctttctcttcctctccctcctccttttcccctctccctcctactctccccctttctctcctccttctctaagaaacccagtcttaattccacacaatgcatgcacatgcagtagcttctctgcttgagtgagctggtgtgattaggttttctaaacatgcacattggccttgctacttgtccttttattcccttcccacagaccataaaccaagaattatttttatttgtattattttgatttttttaaagtaaaatattaacttttcctctttgaaataaattcccatttggaacatc

SEQ ID NO: 412906 - DNA, 144 bp, Homo sapiens
gttggccacacacataactgtctttttagataggacacgtgcagttggggtgccacaatccctactcactcctactgtcccaaggtcactccaaccttgaggcacagtctctgctgctattatcatcacacttgcactggtttt

SEQ ID NO: 412907 - DNA, 428 bp, Homo sapiens
ttaataatattttggggcatttccttacattgtcttgacaagattaaaatgtctgtgccaaaattttgtattttatttggagacttcttatcaaaagtaatgctgccaaaggaagtctaaggaattagtagtgttcccatcacttgtttggagtgtgctattctaaaacactatcatctatcgtaattcctgttaacaaagaatgttggagagcaagaaattaatgtataccagtttccagtttgctcaggcaattctctgattataaaaaggcatttgttaatgaccaagtaaaaagatagtttccttggtggtcctcaacagagtatggccattgttttactcacaaaatatagaaagacatcctcagaattataatacatttggaatggaatgaatcaagtttatcattaatatgctaaggaaaa

SEQ ID NO: 412908 - DNA, 421 bp, Homo sapiens
ccacccaacagctggtattggaataactagctgttcatctagaaaaacaattacgatggctggctgcagtggctcacacctgtaatcccagtactttgggaaactgaggcgggaggatagcttgagcccaggcattcaagaccagcctgggcaacatggcaagaccctgtctctacaaaagtaaaaaactttagctgggtgtggtggcgcacacctgtagtcctagctactccggaggctgaggtgggaagatcacttcagcccaggaggttgaagctgtgtgagccataattgagccatggcactccagtccgggtgacagagggagaccctgtctctacaattcaaatagaccaaagtgctgggactacaggcgtgagccaccgcgcctggccgaaaaatcgaacttttaaaacacaaa

SEQ ID NO: 412909 - DNA, 1106 bp, Homo sapiens
ggttttcccagggcatggaaaggacagggctcccagtggagatatcatgtagctatagggcctagaagtattttttcagtagatgaaatttagaaataatttgaatattttatgctggggaggtagcttgtggagtgaaatggtcgggtaaaggaaacactgagttcaagtgcttctttataaaggacacttaactgatctaaatatttgtcaagctgaatcgctacatccactctcacctgcctgaaatcaatatgctcaagtcaaacgcatttgcctgcatctgaatgtggagaatgaacttcttaaagctgaactggcagctggaaggggagagagaagagctggacagggagccaggacaccggagttcttttccactgtggtgggatctggaagaagctgttgaatctctgtagagttagcttttaaatgctgtgagtctttggaaagctgtgcgaataactgctaaacacccaggacagcttatgcattttttgaaaaaggttcctggtgctggttccagcagaatagacacagagatgcatggcctaactcccactccctcttcaggactgagccacgcagccccccatctgccagaagtgttagctgttgacggctcacagctgagtccctctccaggcattgctgaaaagagccaccttgctctaggatgtgcccccaccctgggggcagcatacattccaagtgattagtccatagtgtggtacaaaggttgtacccatcttgcctgaattcaggatctcttggaaaaccaccccagctctgcagctcctggtggggtgctgaggcctctgctgcagctgcatcgcagtttactttcccctctgcctagtcctgctgccttcactccccaacaggtattgttccccagagaactccctgcccccagtcacctgtaagcaaatctccactgcagtctgtggcctgggaaacctgctctaggatcccaaagtgaacacagcttcccattgaaatgtgtctttgggtgttaatctgtcctgccatctttacatctaatcaagaggtagagcttcccctggtgttcctgctgggtacataaaggatcttttccattgtct

SEQ ID NO: 412910 - DNA, 462 bp, Homo sapiens
cttacttactttgttaaatatgctagcctggaaaagtttactttgaatttatgttctaaaaaatttttttaacaaagtaattttaattctgatatttaacttgataggcactctgtgtatccaaatgtaaagacatcatacagaataattctatgccattataaagcttaaacacaactggcgaaaaaaatgcttttccccattttatatcaaaaagagatactttagtttggactcctaaagaatgaaagtactcagaaaagtgtaaggactttgtttttctagaaatattaagcaacataaacactggggacagaactttatgcgtcaaaagttttgttctagaattaaggagtgaagtcaatatgtcattttgtggtatagcctatttaagactatatatacactaaaacctgtaattaataacattaccattgaatcaataaaaatgtcagtacctga

SEQ ID NO: 412911 - DNA, 1128 bp, Homo sapiens
cgccccacgcccgttccgggccctcccctctttcccgtccatcgcaattcccagacacgcgccccccgccccgaatccatcccaagccggcccacaccacgcccggtccgggccttcccgcctttgccgccggcccccactgctcgggccggatgccggggaacgggctcggccaggtctgacgctcaccgcctagaagccgagccgagcagtcccgcaggctgaggtagagcgggagaagttcgggctctttcctcaggggcccagcggcgcggcagccattttgttgtgttgtgccggttgccgaggggccgcgcgcgcgtggtcggggctagtctcagccacgcccctctccctctccggtactgttggaagggacgcggaggcgtttcccgcctcttttgcagccagcgcgctaggatgccggggagtcttgggcgcgaggcttccggccgcgcggggccgacgggatgcggtgccttcgccttcggattgcgttgcagatggagcctcactctgtcaccaaccaagctgcgaatgcagtggcgcgatctcggctcactgcaatctccaccccccgagttcaagtgattctcctgcctcagcctcccaagtagctgggactatgggcacgcaccaccacgcccagctaattttttttgtatttttagtagagacagggtttcaccatgttcatcaggatggtctcaatctcttgacctcatgatccgcccaccttggcctctcaaagtgtgggaattacaggcgtgagccaccgcgccctgcctatttttttttttgagatggagttttactctatcacccaggctgaagtgcaatggtgcaattatggctcactgcagccctgaccttctgggaccaagcgattctcctgcctcaatctcctgagtaactgggactacaggtatgtgctaccatgcctggctaatttaaaaataattattgtcaagatggggtcttgcagcattgcccaggctggtctccaatttctggcctcaagtgatcctcccacctcagcctcccaaagtattgagattgcaggcatgagccatcatgcccagccaggaattttcattttatacccaaactgttgagactgtttattaa

SEQ ID NO: 412912 - DNA, 678 bp, Homo sapiens
cgccccacgcccgttccgggccctcccctctttcccgtccatcgcaattcccagacacgcgccccccgccccgaatccatcccaagccggcccacaccacgcccggtccgggccttcccgcctttgccgccggcccccactgctcgggccggatgccggggaacgggctcggccaggtctgacgctcaccgcctagaagccgagccgagcagtcccgcaggctgaggtagagcgggagaagttcgggctctttcctcaggggcccagcggcgcggcagccattttgttgtgttgtgccggttgccgaggggccgcgcgcgcgtggtcggggctagtctcagccacgcccctctccctctccggtactgttggaagggacgcggaggcgtttcccgcctcttttgcagccagcgcgctaggatgccggggagtcttgggcgcgaggcttccggccgcgcggggccgacgggatgcggtgccttcgccttcggattgcgttgcaggtgaagtgtcgggtgcagagtcagggggagccgaggtttcatgcggcagctgcccgcagtgctgtggccttcgctgagacaaagctgccgccgccaccctctgaaacacggacacgcttctcagggcctgtgtccgaggacggcctgaggcaccggcgcagcgcctccccggccc

SEQ ID NO: 412913 - DNA, 764 bp, Homo sapiens
gaagcgtagtggcatgatctcaactcactgtaacctccacctcccgggttcaagatatttttctgcctcagcctcccaagtagcagggattacagatgttcaaagatggggacaaacaaatattttgttagaaacctgatgtgagaacctgcatacctgctggtggtgtttcatgatggtctgacggctggctaggctgacttctccctacttcgttcacggctatgaccctgaactggtatctcacaaatggagccaaaggtggaagtgagaagcaggctgggatatggacacgacagaagaaacaaaaatgctccttattaataccgaagatcctttccattttgtgttttcttgaagattctctgagcaatattaaaatcaaaatatcagtgaagcccaagaaactattaacagctcccaggactgtgccctgaagtgagaaggaataatacaaagctgtttatgactcaaaaagaggatcaaaaaccctcctcattctgtcatgcctcagtcattataaagttatgagtttgtgaaatctttagctcaaaaacttgattactgttaccattaccttgagttagctttggaaataaaatatagttacagaaatatggtgtagtatggttaataggtaatttttaaatattgacagccatctgtcactacagacacctggctgcctcttaaaataggatgaagctgtgcacatatcatgggcataccctgtagttcttgcaataatcttttagatgaaaccc

SEQ ID NO: 412914 - DNA, 746 bp, Homo sapiens
catggttgtcagatattgtagcccaacaatttctaactgctgatttgaaaaggagagaccaccacgattctcaagtcaacgcaggaaccctgatccaggatttctttctttcttcctgtttttctcattgctctgtctacctggaccaatgtttacattcctttgcttttcttattccatcctcacttaccccttctgacatttctcacctcttctctcagaggctacatcgctaagaatgaatacttcagctcagcacggcgggcttccgcagcggccacatgaggtgtgatgcccccaccgctgagcgcaggcacagaccacccagctgccttggagggatttgtaaaaggaaacaacccatgtacctgttaagtgcagatgtcagcctgaacccaggatgcttttcgtctttccaaggaggctgctgcctttaaaaaccagaacaacataaaaggaaaagaagtcaatccacagacagcaaaggagggcctcagcacttgcatttgagaactggctcttctactcacctcgctctgcaagagttacttaaaaataccccacacctcgctcattttgctcatcattgttaaaatgaggtaagactccatgatccttccagtcctgtgatctctgatttccagtataaaaactactacaaacccataaggcacaggattagctagctgggcagatgaggagttcagtgtgcatgtagggggcgccgtggcaatcttggatgcaaa

SEQ ID NO: 412915 - DNA, 510 bp, Homo sapiens
catggttgtcagatattgtagcccaacaatttctaactgctgatttgaaaaggagagaccaccacgattctcaagtcaacgcaggaaccctgatccaggatttctttctttcttcctgtttttctcattgctctgtctacctggaccaatgtttacattcctttgcttttcttattccatcctcacttaccccttctgacatttctcacctcttctctcagaggctacatcgctaagaatgaatacttcagctcaggtaatttctttcttcagttactttctttttcttagcatgcaagcctcaaaaaatcctcacttgaattacctgtgattgccttgtttctctaggcctttggccctttctagagaagtgtaaactttgcagagggtaatgtaaatgaaggatcggcagaggcagaaatgcaggagctccagggtaaaaatctgtctgtctagctggctcccggtccatggagattaggatcctgctgtgctcacaggcacccccac

SEQ ID NO: 412916 - DNA, 386 bp, Homo sapiens
ttattaacagtaactcactctaagtgcagtttgtacacataaagcacttaacagctctgccctccaacagcaccaccgaagtcttggataaaagccatatcccttattaacctggtccgaaggcggggtgtgacttggcctctgtctccctctccaaactcatctcttgaacccccacactcccataggtcctggtcacactgattcttgtcaattcctggaacacatttgactcatcaaccccaaagcttcttcaccgttccagggcttgccctttgcccatgcctaccccttctttcattcttcagctcttcccttaaatgtcaccctgatggaggactatccctcaccagtctagtctttcctgctattttctatcatgaaag

SEQ ID NO: 412917 - DNA, 113 bp, Homo sapiens
aacagctttcctcatgtgtagtttgattttgctgtatttctagctaaagggaaaagaagttaactggaaggagacacttatgttttcctcatccatgtatttgtttcagtttc

SEQ ID NO: 412918 - DNA, 426 bp, Homo sapiens
ggaagcgaggtttgagctaaacctgaggtgagcgggagggaagagggtgacacgccaggtagagaggccagcatgtgtgaggccctggtgtacccgggggaacagagaatccaaggtgctgggggaagatggtacgagaagaggtcacagtgacaggcagggtctcacggggcttccagccatggttaggattttggcgttgactccaagagccgcagggttcgagcttccctctcattgcgcccccatctgtaatcattgcccatttatcttctctctccctgcaccgccttgggaggccctcctgggcagactcttagagcccgcacaggctttgccaaagagtagggtaaggggggttggtgaagggatggatggatcgatgaacagataggactagacagggatgtggagaaaggaagttgt

SEQ ID NO: 412919 - DNA, 435 bp, Homo sapiens
gccaaaggaatgcagaaatccctcgtcccaagtcgggcccctggggaggaggcggccacagctgggcccctcccttctgaaaccagcctgcacccaggacagctcctccccagtaaggttcacaaacagattcacagccaagttgcaaaggggcagttccccaaaaccagagtggaaagaggtctggggctgatgccaggaaatggtcagaaggggaggagtgggacagggccagaggaggacttggactatttttaaaaactctctcccaaaaagaccacattcttcctctgatgagtcagaagcatgtggccggcaaaggggacaggatccgcgagcctccgcggctgccaccgtcaccaggcaggcacataccccagcctttcccacggggcaggtgtgagaccctggcgtctattcagtttcccagggaag

SEQ ID NO: 412920 - DNA, 384 bp, Homo sapiens
caggcgtttgagacgagcctgggcagcatggtgagactccttctctgcaaaaaaatttaaactttggctgggcgtggtggcgcatgcctgcggtctcagctactcgggaggctgaggtggaagcactgcttgggcctgggaggtcaaggctccagtgagctgtgattgtgcttctgcactctagcctgggcaacagagcgagaccctgtttctaaaaaaaaaaagaaagcaagaaaaaaagtagatatgccttcctttccattaacagggactcagaatgtggctgtttaaattgttaggtttttcccgtgctttgatgtgttttttatggctgttttcttgctttgtctgctaatgacttttctcgccttgtttcaggtgagt

SEQ ID NO: 412921 - DNA, 464 bp, Homo sapiens
caccaacataaggagggcaggggggactttgcagagaacatcactaacaacaaacatgagtttcctgctcaaaatgagactatgtcagaagaaggcagcctgcagagatgagaggttctacagtaacagtgagcaaactcagatcttcattaagcacctatcagggccaggcttccctcaggcatctttgcacctacagcatctagctcagtccctgactctagtgtttagttgtccagaatgcgctggattactaagagaacaacctgatgtaaaatgaaaatgaaaacctagccagacactgcccagtattaacactgacatccatttgctagagatagaatatggaaagtgagactatgaacaaatagaggtggctgcaaataaaataatgtatgaattttgtgactttaaatacctttaaaaaagattgtatcacaacatgaactgtaatggccagattg

SEQ ID NO: 412922 - DNA, 430 bp, Homo sapiens
cctggtaggacacagtgagaggaatacaggtatcacttctgtgctacctctgccacagagacataacataaatagaatcacaagggaacctcagacaaacccagaatgagggcttgtctcattttataaaataattggcctataagtgtcaggatcatgacagtcacagagagaactacattagactgaggagactaatgagatgtgagtgactgagtgaatgaatgaaggaacaaagtgaagggaggaacgcgatggtgagaaagggggttgaagaagacagaggccggatctggcatcatcgttagcatccaaacagcctcctaagcggccacagggaggtccaggcactgccccaaatgttcaacacgcactcattcttcaccctaaacctagctggtggtcgctgttattattcctgcactgaaaa

SEQ ID NO: 412923 - DNA, 365 bp, Homo sapiens
catgggaggccttgtggagtggctgagtttggaatttatcccagggtaccggggagccaccagtgggcttgaagcaggggggttttgtgatcacgtgtgtgctttgggaaggtcactctggcagctgtgagagggaggaggccggaagcagggaggagcctgcagttacattagaagaagcaagagtctgggcctggtggctcacgcttataatcccagcactttgggaggctgaagcaggtggattgcttgagctcaggagtttgagaccagcctaggcaacatggcaaaaccccatctctacaaaaaatacaaaaattagctgggcacggtggtgtgcacctgtagcatcagctactgaggag

SEQ ID NO: 412924 - DNA, 238 bp, Homo sapiens
gaactcctgacctcaagcgatccacccacctcagccacccagagtgctggaattacaggcatcagccaccccgcctggcctgagaacaaatgttttgaaaccattggactttctaagataactggggaaattgtgtacactgggaagaggagtacacctagtgccctgggaactctaggagaaaggatctggcagatgtgactgagcaggaacagccagtgaggtgggaggaaaccag

SEQ ID NO: 412925 - DNA, 499 bp, Homo sapiens
gctcttgaacctgtggttcaactgaatctgtcctataggtgataaagacctctttgtaagttaccatagagcctctcatacttagctattaactgcttgttaacagtcccatttcttgttttccacttgtagtgtttaagttagcaataaccagccaactctgctgtctctgcaagcattttcaaatgcctgtatcacacttagccccattatttccttctattgggacagggttccaagtcaacactggtgaaattaagcaattaagctgcaaagttatgtctgggactatgaatgctccatctaccaactaaggtggcatcttctcagtcaggtaatggatgggactgttccaatattatcaccccagaagtagatgccaagatgggactaaatgtacaagactttttattagggaaaacacctgtgagagaagatagggaaggagctgggaaagaactggtggactatcacactaggatgcaagtctgaccccaaa

SEQ ID NO: 412926 - DNA, 371 bp, Homo sapiens
aacctgctgtctccttcgttcttggtcttatttgtccaatatccccagctagaattgtcagaaatgattctccagttctccctcacttgacacctcctccttttagtcctgccttttgaagaggctcagacctgtgtgttcctttccacgtccctggccctcccttgcatcagccttgcctaacccccacctgggctgcgagcaggagctgcccttggtggactcttccttctgctcagtctgagaaagtggcgatgctcatgtcactgtaccatttaaaactgcgtggactccttttttgtggttgtggtttggtttctaggcagatcacgctggaacgtcctcacttcacgtgctcagtctggccctcg

SEQ ID NO: 412927 - DNA, 274 bp, Homo sapiens
gctgcattcctacaactgatgccctatgacttccttcctactttcttgttgctcatttcttagtgtctgataaataggctaacatttccagtggaattaatgtatcattaagtagattttaaacacaaaaacctgtgctactccttcttaagaatgaggtctgtttaccttctgagtgggttatttaataaaaatattaggtgagttaaattaataaaaacaaacaacaacaaaaaacaaataccactgtgctcactgccactactttccttcc

SEQ ID NO: 412928 - DNA, 153 bp, Homo sapiens
aacatgagttggatcagcctttggaagatttactgaaagagtgctccaggcaacgggaacagcaagtataacacttgctattttaaaaacaaggaggaggctgggcactgcggctcatgcctgtagtcccagctactcatgagcctgatgctg

SEQ ID NO: 412929 - DNA, 1002 bp, Homo sapiens
tataccacctgaaatatggctagcagaaggaattttgcgttttagttaaatttaaacaccctcatgtggctagtgccgaccatactggacagtgcagttctagattatggatcccatatggtcaggatcttattacagactgaatttggtgaaaataacaatgttaggttaagactctcaaattcttggcatgtaagttattgatttgtaatgtattctgagctggcatttaaaattacctcatttttacaaggatacaagagattgaaggaacaaatatattttagatgtagagtttatctgttgcagggtttggcatgtaggccaggaaccaagattccaggagtaagaatggcacacttggtgaaagagtgctgtgcacttggatgctgatttacaagtgacagagccactgtgtcccacgtctttctccttgcctgtttctctgggttttcagttatctatgtttattggaaacagttatcacagagttgagtaccttgaagatctcttgtggacatccccacttccttcccacatactcaccagtaccagggtcagcttcaggtaggaggatggcacagactcaaggtcaagcagaggtgtgagccacagaagcagagtagcaggccaagttccagcatcctggctgccaggaccaccgtgcaggcttaagaagctggagctttaggatatggagtgtccatcacttggcatctttctcatagcccaggtggcatctgagaattaggttagggttgatttggaccctatggtttggtaaatcatgtcccttgaatgtatacaaatgatgtctgttgatatttaaaatatgtttctttctgtttaattgtaaaggggatcaggaagtcttttctcccacgagtctcaaataatttcatagttagaatctggtaatttcaggccagcctagggcttttcatgactctcactttttaaggctggtatcctcatttgctggatgagtaggggttctgctga

SEQ ID NO: 412930 - DNA, 841 bp, Homo sapiens
tggtacacaactcaggctccaagcacaaccttctatgccttcttggtacgttcacgcctgcgaccccgggtactggcactctgcaaactattcggggcaagtgtctgtttcactcgcgttctctgcttccttcgaacttgaccatgtgccgggtcccttgtgcttggcctggagaactctggtcgatgtcacgagtgcccagaagccgaggagcttgaacaaaccctgggctgctcagggatgggccctagcgcaggatttaggcttgcagtccattggtacaggcacgccggagctgcccctcaagccccaagttggccgtgccatcctgcccctccactcccgactatgagaatcatgtttgtgggccagctcagcagccgagcactcagtgtgagatgaacaatggggctcacccttcagaggacaatgacttttacatcaactacaaggacatcgacctggcttcccagcctgtctactgtaacctgcagtcactgggccaggccccaatggatgaagaggagtacgtgatccccgggcactgagcctaagatgtcctaacctccacccagaaccccttcagtccctgctgggtgactcagggcgtcctaacgcctccatggcctcagtttccccatctgaagaatgggtacaggaaaggattgtccttgaggccccaggaagctctgccgccccctccctgtccctcatgccgctcctcagctccctcagctcctagagggggaagaggagagacccccaacaaggggacaggacggtcactgtgccaatcctgtcatcaccctcctgtggatgtacaggcagtgctcaataaatg

SEQ ID NO: 412931 - DNA, 351 bp, Homo sapiens
ttcaggcaagtgcttgcagttctcctgcctagctggccacgctgggccatgtggttctccagcccagcccgccactggactgtggtacagtgattctcttgcccagaccccctctggactatggtaaggtggttcccctgccaagccctccactggactgtggtaaagtgattctcttgcccagtcccccactgggactgtgtgtaaggtggttctcctgcccagctcccactggactgtgtgtaaggcggtttccctaaccagcccaccaccactggactgtgtaaggcagttcccctgcccagtcccctactggactgtgtgtaaggtggttctcctacccagtcccct

SEQ ID NO: 412932 - DNA, 734 bp, Homo sapiens
agaagagaataagaagagactggaaaattggtcattctctcacagcttaagtttagatctggcggatgatctctcgtcgctcggggacaagtttgtactggataacctcctccagctcggacagcatgtggcaagaaaccatggcctgatggaagcaaatcgcattccaaactaattactgcacgaacaatccaaaagacaggattaatttaaatcattccttctggtgtcagggtatctgccgatcagagaaaacaggcatgtttccagcagcctggatgaaaagagaaattcgctgaagaagggcattttcccagaactgaatggcttgagaggaggtattatccaatttctcatcgaagacagaaatgtatggcatccaaaactttaacatctatctaaggatggggctggttaccagaaagaccaagtaattatcgggtttgaactttcagccctgtccactgacatccaggaaaggtgaagaggttgaaaatgaaaggcaataaaaactcttgaacaatgagcttccaggttgatgaaggtgctgggagggtgaaggtaaaccccagtaccacaggacagaagcttctgcactccagacccttctagaccttccctcattgtacctgttcacctctatcttttataataccctttataataaacaaagatgctggccgcagagcccgccgggccgagatgatgttcacactcagacctctccacccatt

SEQ ID NO: 412933 - DNA, 768 bp, Homo sapiens
aatgggataactggccatccttcccagaacatttagactcctgactcccagacctggagtgacagtttctcatgttaaaatgatcagaatatctggcggatgatctctcgtcgctcggggacaagtttgtactggataacctcctccagctcggacagcatgtggcaagaaaccatggcctgatggaagcaaatcgcattccaaactaattactgcacgaacaatccaaaagacaggattaatttaaatcattccttctggtgtcagggtatctgccgatcagagaaaacaggcatgtttccagcagcctggatgaaaagagaaattcgctgaagaagggcattttcccagaactgaatggcttgagaggaggtattatccaatttctcatcgaagacagaaatgtatggcatccaaaactttaacatctatctaaggatggggctggttaccagaaagaccaagtaattatcgggtttgaactttcagccctgtccactgacatccaggaaaggtgaagaggttgaaaatgaaaggcaataaaaactcttgaacaatgagcttccaggttgatgaaggtgctgggagggtgaaggtaaaccccagtaccacaggacagaagcttctgcactccagacccttctagaccttccctcattgtacctgttcacctctatcttttataataccctttataataaacaaagatgctggccgcagagcccgccgggccgagatgatgttcacactcagacctctccacccatt

SEQ ID NO: 412934 - DNA, 214 bp, Homo sapiens
ctgatggaagcaaatcgcattccaaactaattactgcacgaacaatccaaaagacaggattaatttaaatcattccttctggtgtcagggtatctgccgatcagagaaaacaggcatgtttccagcagcctgtaagttctcaatagcccattctgaaaaaagtatggaaataagcctcaaaaatgacaatgtgcagaatagttgacacttaccc

SEQ ID NO: 412935 - DNA, 284 bp, Homo sapiens
gggatcgctgtcagcgcgatttttctctgggtttggtaagtctgttggaacgcctagatcccgaggtctgtgagatggggtatcactggttgctatgaggattccaggaagcccaagtgaggtacggcactcctggtctggggctgccacagctggatccccaggaggcctccctgccacctgcccctcaaactgctgagcttttcacacctctactgtctgcacccacctgctgggcccctcccctctccccgttgttcccaccaccactcacctatcccgtg

SEQ ID NO: 412936 - DNA, 813 bp, Homo sapiens
gcacctttcacaggtctgggatgttcttggaagtcaagtatgactttcctcctttcttattttttatagtgccaccccacagaaacatttttaaataacagagagtaacttcaatggaaagagtcaattccgagatttctgagcttattagcaactctaaataatatgtaatgcaactcattgtctaaaatgaactctttcttgagcataaatactctaagaacaagtccaagctggttttcattatttttcagctccagagaaggaagaagctttccattttttaaggcttaaaaaaaacacccaagtatctttaaagcagtttagataccaagagttgctcttctaacaagtgatgtcaactgcgaataagcaaagagtttcagaggttgccagattgtcacagacgactttggagaacccagtttcattcccaaggctgctatcaataaatcttgctgacggccctcttgttttgatttgtgaactgcagccctattagttttcctccctgaccaagactctttggatggcattttggaattcacaaggaaagaaaacctatagtggtctatgtctgtcgatgatatctattcagctaacacatgagcattctgccaggcagcacagaaccctaacctacagagagctgcagagaaacaccacggagaggtggaggaggaggatgaagcacttcttaaacagaggtcgactaaccagcaaattcttctttcttcctttttttttcttaaagggatctatattctagcttctaaaaacttgagtctgaacagaaataaaaagaaagagtcg

SEQ ID NO: 412937 - DNA, 526 bp, Homo sapiens
gcacctttcacaggtctgggatgttcttggaagtcaagtatgactttcctcctttcttattttttatagtgccaccccacagaaacatttttaaataacagagagtaacttcaatggaaagagtcaattccgagatttctgagcttattagcaactctaaataatatgtaatgcaactcattgtctaaaatgaactctttcttgagcataaatactctaagaacaagtccaagctggttttcattatttttcagctccagagaaggaagaagctttccattttttaaggcttaaaaaaaacacccaagtatctttaaagcagtttagataccaaggtaagagttacagttgatggcagagtcagaactttccagctgtgtagaatttattcattaaagccatgtgttaaaattgagaaacaactggaagatacaaacacaaaaagagtttgtttatgcaaattcttgaatagacctcctagttgctcttaatcaatattgataaaaagcatgtataatgaacttga

SEQ ID NO: 412938 - DNA, 474 bp, Homo sapiens
ttggtttcttttgaggcctttctcttgctttgcagatgaccaccttctccctgcatcctcacctcatctgtcttctgtgcacatctgtgtcctcatctccacttataaggacgccagtcatatgggattagggtccacccatatgaccccatttcaactgtctccaagtacagtcacatttggaggtactgggggttaggatgtcaacatagaaccactccagggacagaattcagccacctatggcactggctgaaggaggtggccctggagccaggcctggaacctgctgagacagagggacggggttgcaggaagactgggctgcatcggccaaggtacagggtgagtccggctgggtgtgggaagaagaatggagggcacacgggatgaggctgagaggtgactgagcttggcacacagtgaagaggcccatgcgctccagtgtgtcttctgatggccaacacctgtgct

SEQ ID NO: 412939 - DNA, 121 bp, Homo sapiens
gatgtgtttaaatgcaaaaagcactgctagaacttttgaaaaaaaaattcctaaaaaggggtcctttggaggcctgttaggtagatattgtgttataataacatatttgcatagtacttag

SEQ ID NO: 412940 - DNA, 103 bp, Homo sapiens
gctgagcacccatttaccaaaagggaggctgagccttggcagaggaaaggggtgtgttcagggccacacaccgagacctgggatcctggctctgagtccactg

SEQ ID NO: 412941 - DNA, 670 bp, Homo sapiens
cccacaataaacataaattatttatctggggaggtattacatactgttattatatgggccattcgcttgcccaagaaaatagagcctgctggtcactttaggcatccataaaaactataatgtcattgcccaatacaggatgtattatcagtgcatgggagtgcttaatgttacattcttcaccaatacatattgtgatgcttttataatctctttaacataaataatatttccatgtagttaaggctaaacatgacataaagatacaaaacagttgtagaaatggtcagaatatttctcagctaccaatatcctttttcctgagtggtaaagagaggatattgttgaagagataacaatttttaaaaataactgtatcagatcagatctttgtattttatagacatttttctgattcgagaaaaaattactcttatgcattcaagtggccctaactccatccttgccactcacatggtgcttgaaaacgtcttgaagtaaggaatcacccaactactctccctttctacccttttccaaagagacttctgctctaaaacaaatttttgtaagtttttgcccaatctcctggatggatcacaaattatgccaggtatgatttaaataaaactaatgtctttattttttaaaaaatcctatggattttcta

SEQ ID NO: 412942 - DNA, 824 bp, Homo sapiens
aaagaaaagaaaaaaggtacagcgcctatccacatcccaagctagtaagatgcggagccagactggaagcagggagtctggaaaggggcagagagagtggagcagagaaagactcactgcagtccaaccagatggccaattaacagagcagtcaagaaagaaaccgcaggtgaaaagcttgtcagcacgctgtggctaaggctcctcatccaggacaggcatgaagcagcagatgcacacacagtgacaggtctgctgagaacagctggccactcaggagcccaggagagtcaccaacacagccaaggacaaaggtggagagtcccttaaacatgcctgactctgagatgtgtgaagtcgaacaggtagtgggaaataagaattatttttatggttagggaatagacaccttggagtcatggaagcaagtttccatgcagtgcacttcaatgcgttcttttattctatggacaaatccattcccatactagcaaatagcgtatcttccattctgtacgtgtctttgcactctcatggatgtaggtctggaataatgcatctagaaagactgaagcagaggcctaactctcccaactctgcatgaaacaaggggaatattttttatcttgatgctgtggttgattacaactcattttgttgtttaatgctgccacaactaccaaaaccacccatggtgctacagtttataatttggcaatcaaatgcctcagcatgtggccacctgaaaaatgctttttatggtgttataatccctattagtaagctgttaacccttaattactgtgtacaacagtcctgaggct

SEQ ID NO: 412943 - DNA, 203 bp, Homo sapiens
acagcagactgcaaatcgaatgtgagttatgctggtctactcatcaaatctaatcagaagttttgttctcacattttggatctgcattcaaaatgggactccagaaagatgacaaaagttatataaaagacttaaaaccggtcttgtaggaacagccagaggaatttaagtgacatgattctttttttttttttttttttttt

SEQ ID NO: 412944 - DNA, 332 bp, Homo sapiens
aaagatctaagggggtagagaggaagagcactgtcaaccagccaactattacaccccaaggacaggacagtccctgccctggggacacagatgctggtaactgggggagcttccactgcaccagttataacagtgcaaaaacagtgagaaggaggaaggccagggtaccctgaaggctcaggtaccccttctgggaggaagtgacaagagaactgtgggaagggtctaaagagttgacctccaagccctcctgccactccctcacctgtgaatgttgggcaccatcccctccagggcctagtgcagcttgccctccccttccccccttcccg

SEQ ID NO: 412945 - DNA, 229 bp, Homo sapiens
ggaggtctggaccatctggaggaaagagaataaagccacaggtgatgtcatccaagggaaggggatgctcctggtctcttaaagggacacagtgaccctctgaaccaagacacaacctcaagtgacagccaaatcccatctatgtttactaagcccaagcctgaggtattcccctgtttctctcattacaagctgtgggcccctagtgtcccatgacaagagcgcccct

SEQ ID NO: 412946 - DNA, 383 bp, Homo sapiens
tccttcacggtaggaatatagcgccatatacccctccttcatggtagatatatagcaccatatatccctcgttcactgtagatatatagcaccatataccccccattcactgtaggtatacagcaccatatacccctccttcatggtaggtattcagctccatataaccctccttcatggcaggtattcagagccatatacccctccttcgcggtaggtatacagcaccatatactcctcgttcactgtaggtatacagcaccatataaccctccttcatggcaggtattcagtgccatatacccctccctcacggtaggtatacagcgccctatacccctccctctcggtaggtattcagcgccctatacccctccctcgcg

SEQ ID NO: 412947 - DNA, 1204 bp, Homo sapiens
agggttgcgtgcctccggccctagcctgcgcaggcggcctgagcttggggctctgctacgccacccacgcccaccttggcggagggcggggccccacggctctcaaacttgcgcgccaaagacggagccacctggcgtactggtggaaagcgcagacttcagagccacacccgtagttaagtattcggactctgagattccagggtggggcccaggccatccgcgttttcacccagcatcgtgtgattcggcagcaggtggtctgtggcccgcactttgagaaaccctggtgcagaaggttcatggttagtggttctctctggaaggaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaagctctaatatcctggatagtgcctttaccctcaagctgacagcaaatggctttaacggtgctaggtatcacaactctacacaatgtccagaagaagaaaagaagctttctcttctcagggttctctccaagcagtatttcttcaaatgaagaccttttacagatactcagatgactgaaatctcttatcactggtggacatgggtggtccacgcctggtatcccagcctttgggaggcgaggcaaatcatcctctgaggccggagttgaaaaccaccgtggcacactggtgtaaccccgtgtcttctaaacgcccaaattcctggcaattggggcggacgtggacaccaaatcggaggagagagggagacattacccgcggggtggtgctgcggcccgcatggtgtgcttacccctccgggagaagatgctcctcaaaaaaaaaggggggtcgtattacggggcagcaaccctataagcactcaaataaaaaggcgggccctaagagattgaacctgttggatcaaatattttctttttcgttttgtctcctctctactccttctacatgcatctcaggcagagaagagcagagagggggggacgc

SEQ ID NO: 412948 - DNA, 730 bp, Homo sapiens
gatgcaaactctgctgtctcagtgtaattggtatgtaagtgtgcagcaggcatatgaatctgttggtcctgtaacagttgggatgcagtggcacaattgtagctcactgtaatctctacctcctacacctaagggaaccttaccacctcagcactcggaatagctaggactttaggtctgtgtgctaccacccatggctaatttataaaataatttctttgtagagacaggatctttctatatagcctgggctggtctcaaactcctggcctcaaggtatcctccccactctgcatcacaaagagctgtcattacatgtgtgagataccataccctgcccatggtagaatattaacacatgggtgtgaaatgttggcttcagtctggcatgttattactttattaacagtaaagaataatatctgatcatgaaattgtttttttttgtaaatagaatattttctatttacattgatgcttttgtaaatagaatatttgactctgatgaagacatattataatttcactatggatatgacctgaaatggaaaaaattgacttacagaaaaaatacaccaaagaagtcaccattttatatttgttcttattacaattatctttcaagccataaaaaacaaaaattagtgattttattaccaactgagaagattattttctgccaagcaatctctaaacattaacttttactaggaatgtattcatgaaaggg

SEQ ID NO: 412949 - DNA, 274 bp, Homo sapiens
gtcgacagcaaccaaagagtcccatattactgcacgttcccatcgctattttatgtgaaggtggtcctgggggctgttctgaattctcagtttccttttttcccctccccagttctttgaaaatatcagaaacggacttgtggcatctttgaaaagctacttaaaatgtgctgctgtgctctgaacttgaaaatgtgcttttaatacaaagtttgtgcagcccttgctgctcatacgagatgaatcttaccatgtggtggatgcccgtctcatg

SEQ ID NO: 412950 - DNA, 1053 bp, Homo sapiens
agtcgccggaacgcgggcgggggcttctgggagttgtagtctgttgggggcgtgcgcagtcgggatggaagcttcctggcgccaggtggccggtggccgaggccgatcccggggacgggccactgccgccccctcaggaaatggagtccatctccgcggcgccggaggagggcgagagaaggggtcggtgggcgcagttccttctggcaccagtcccggaggagtcgcgaccacggcggctgcagggagcaggcacagccccgcaggatcccaagccctgcagactaccgcagccagcgagctaatgtctcagaaaaaatttgaagaaatcaagaaagctaaccaagctgcagccagaaaacttgttgaagaacagtttagctcttcatctgaagaaggagatgaagattttgaaggaaaacagggaaaaatacttgcaaatacgtttataacatacactactcagacagatggagatacacgtgaattagagcgaacaaaacaatatgtaaatgaagcttttcaagcaggggctatgacatgcctaatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcagg

SEQ ID NO: 412951 - DNA, 572 bp, Homo sapiens
gccgatcccggggacgggccactgccgcccctcaggacggcttccagcccctgcttgaagagcttcatttgtattgcttcggtgaagagaaaccaagcagtttggagctgttcgggatgtttctgtatatttcacatgccctgtatccagaagtgggctaaagacagccagtttcttgtatcttctgtgactgatgatgattttggaaagaaagattgtccctggccttgtccaaaatgtaggtttgaatacaaacgatctgaaacacctagtaggtactattgctattgtggaaaagtagaagatccacctttagatccgtggcttgtgcctcattcatgtggccaagtatgtgagcgtgaatttaaacctccttgtggccataaatgtttactcctctgtcatccaggtccctgccctccttgtccaaagatggtcacaactacttgttactgtaagaaagcaaaacctatccctcgtaggtgcagtgccaaggaatggtcttgtcagctgccatgtggacagaagttgctttgtgggcaacataagtgtgaaaatccttgtcatgcagg

SEQ ID NO: 412952 - DNA, 680 bp, Homo sapiens
catgggggaaactgcccccatgatccaatgacctccactcagtcctgcccttgacacgtggagattatggggatttcaattcaaagtgagatttgggtggggacatagagccaaactatatcagaagtctgacaatacctgatattaaaactcataagagtacagtaatcaaaactgtgatattgatcaaatgttcaacatgaggactatcattaataatattgcatagtgtactagaaaatttgctcttaccactcacagacatacacacacatatgcacaaaggggtaaccgtgaaatgatgaataagctaatgtgcttgactataataaccatttcactatgtataagtgtatcagaacatcatatcatataccttaatatatacagtaaagtagtttttttaatgtagagaattagatcaatgaaacaaattggaaagttaagaaacagtttacatatgtggacaactgatcttcaataaggatacaaaagtaattcagtgcaaaaaaatcatcttttcaacaaattgtgggataattggatttatatatgcaaaagaagtgaactttggtttacatctcactcatatgcaaaaattaccttaaaatggatggtatccctaaatataaaacctaaagctaaaaaagtcttctagaaaaaaacacaggagaaaatct

SEQ ID NO: 412953 - DNA, 1495 bp, Homo sapiens
tgatgaacaattttattctcagtcactttgcaagccagggacctccagccgatgatgccccacctgggcctcgctgggccacaatacctgctgcagagacagctcgcccactcaccccacctgggccgagtctggcttgtgcactggttcccaagttcttgtcctgcacccacaaagaatggggatacactggcaatcgaagagtgagggtggagattttattgagtgatacaataggtggggggtttattgagtgataaaacagttttcaacagagaggcgatttgggggtggtccccctacttaaaggcaggaaagtcccctcaatgtggctgagtccagggcttttatgggctcagtattggggaggggcaggtcataggtagtattagagaaggcaacattcaactggttaaaagcattattcaggctgggtgttgtggctcatgcctgtaatcccaacactttgggaggcacgagccactgtgcccagccccttctttctttaatgacagttctggagaccaaagagactgggaacacagggttttgggaacgtgggagttctgggaggtgacggacaggcttgagagcgggcccgcactgaagggctagagtgagctgcatttctgggtcttggatggggcaggggctgtgggcacttgggacctggggaaagctttcaccacatccctgggccctgtggctcagctgtgtgacatcgactccccgccacaccctcgggggcaggatgtcacgccccatccagagccctgcagccgggcaggatcctaggccacagtgtgtctcccgggatgctaaaacaggacagaggtcattccttcgttcattttgggggtgtttcccaagagtgggtggcagagtcctccatccgacccttcccacctggggcagccatgtcggttggtggccaagcctccctgtgatggcagtgcccgggcccctaggcaaggcatggcatatcccaccatgcagctcacactttgctcacgtcacggcacagatgcctggaggccttactgtgtcagcccacatggctcttctggacctgttccattacagaggaaaggttgccgagggaggcagatgttagcaaatgagaacactccagaaagcccggctccgggaggggccccaggtccatctgtgaagttctagtctgggctttggggatgagggactgaagactggaggccaatccctgtcctgctagcaaagtgatgcagggcacacagaatcattgagcccagcaaacttgaccttggggatgacagagacttcacaggagacacgccataacagaaggggcactaaagggctggaggcaccggctttccctaggcagggaccaccccattgaagagatgcctttgggttcagtcccagtgggaggagcaagaggactgtaagaagatgaggacgaggagccatgtgggaggaggaggggccacttgtgggacgaggaggggcccct

SEQ ID NO: 412954 - DNA, 1284 bp, Homo sapiens
tttttttgagacagtctcgctctgtcgtccgggctagagtgcaatggcttgatcttggctcactgcaacctctgcctcccgggttcaagcaattctcctgcctcagcctcctgagtagctgggattacaggcacccgccaccacacccagctaatttttgtatttttagtaaagatggggtttcaccatgttgcccaggctggtctcaaactgacctcaggtgatccacccgcctcggcctcccaaagtgctgggatgacaggcacgagccactgtgcccagccccttctttctttaatgacagttctggagaccaaagagactgggaacacagggttttgggaacgtgggagttctgggaggtgacggacaggcttgagagcgggcccgcactgaagggctagagtgagctgcatttctgggtcttggatggggcaggggctgtgggcacttgggacctggggaaagctttcaccacatccctgggccctgtggctcagctgtgtgacatcgactccccgccacaccctcgggggcaggatgtcacgccccatccagagccctgcagccgggcaggatcctaggccacagtgtgtctcccgggatgctaaaacaggacagaggtcattccttcgttcattttgggggtgtttcccaagagtgggtggcagagtcctccatccgacccttcccacctggggcagccatgtcggttggtggccaagcctccctgtgatggcagtgcccgggcccctaggcaaggcatggcatatcccaccatgcagctcacactttgctcacgtcacggcacagatgcctggaggccttactgtgtcagcccacatggctcttctggacctgttccattacagaggaaaggttgccgagggaggcagatgttagcaaatgagaacactccagaaagcccggctccgggaggggccccaggtccatctgtgaagttctagtctgggctttggggatgagggactgaagactggaggccaatccctgtcctgctagcaaagtgatgcagggcacacagaatcattgagcccagcaaacttgaccttggggatgacagagacttcacaggagacacgccataacagaaggggcactaaagggctggaggcaccggctttccctaggcagggaccaccccattgaagagatgcctttgggttcagtcccagtgggaggagcaagaggactgtaagaagatgaggacgaggagccatgtgggaggaggaggggccacttgtgggacgaggaggggcccct

SEQ ID NO: 412955 - DNA, 714 bp, Homo sapiens
tgatgaacaattttattctcagtcactttgcaagccagggacctccagccgatgatgccccacctgggcctcgctgggccacaatacctgctgcagagacagctcgcccactcaccccacctgggccgagtctggcttgtgcactggttcccaagttcttgtcctgcacccacaaagaatggggatacactggcaatcgaagagtgagggtggagattttattgagtgatacaataggtggggggtttattgagtgataaaacagttttcaacagagaggcgatttgggggtggtccccctacttaaaggcaggaaagtcccctcaatgtggctgagtccagggcttttatgggctcagtattggggaggggcaggtcataggtagtattagagaaggcaacattcaactggttaaaagcattattcaggctgggtgttgtggctcatgcctgtaatcccaacactttgggaggccgaggcaggcagatcatcatctgagatcaggagtttgggaccagcctgggcaacatggtgaaaccttatctctactaaaatacaaaaaatagctgggtgtggtagcattcacgttcgcctgtaatcccagctactggggaggctgaggcatgagaattgcttgcaccaggaggtagaggttgcagtcagccaggatcgtgctactgcactccagcctgggtgacagagtgaggctctct

SEQ ID NO: 412956 - DNA, 1596 bp, Homo sapiens
tgatgaacaattttattctcagtcactttgcaagccagggacctccagccgatgatgccccacctgggcctcgctgggccacaatacctgctgcagagacagctcgcccactcaccccacctgggccgagtctggcttgtgcactggttcccaagttcttgtcctgcacccacaaagaatggggatacactggcaatcgaagagtgagggtggagattttattgagtgatacaataggtggggggtttattgagtgataaaacagttttcaacagagaggcgatttgggggtggtccccctacttaaaggcaggaaagtcccctcaatgtggctgagtccagggcttttatgggctcagtattggggaggggcaggtcataggtagtattagagaaggcaacattcaactggttaaaagcattattcaggctgggtgttgtggctcatgcctgtaatcccaacactttgggaggccgaggcaggcagatcatcatctgagatcaggagtttgggaccagcctgggcaacatggtgatccacccgcctcggcctcccaaagtgctgggatgacaggcacgagccactgtgcccagccccttctttctttaatgacagttctggagaccaaagagactgggaacacagggttttgggaacgtgggagttctgggaggtgacggacaggcttgagagcgggcccgcactgaagggctagagtgagctgcatttctgggtcttggatggggcaggggctgtgggcacttgggacctggggaaagctttcaccacatccctgggccctgtggctcagctgtgtgacatcgactccccgccacaccctcgggggcaggatgtcacgccccatccagagccctgcagccgggcaggatcctaggccacagtgtgtctcccgggatgctaaaacaggacagaggtcattccttcgttcattttgggggtgtttcccaagagtgggtggcagagtcctccatccgacccttcccacctggggcagccatgtcggttggtggccaagcctccctgtgatggcagtgcccgggcccctaggcaaggcatggcatatcccaccatgcagctcacactttgctcacgtcacggcacagatgcctggaggccttactgtgtcagcccacatggctcttctggacctgttccattacagaggaaaggttgccgagggaggcagatgttagcaaatgagaacactccagaaagcccggctccgggaggggccccaggtccatctgtgaagttctagtctgggctttggggatgagggactgaagactggaggccaatccctgtcctgctagcaaagtgatgcagggcacacagaatcattgagcccagcaaacttgaccttggggatgacagagacttcacaggagacacgccataacagaaggggcactaaagggctggaggcaccggctttccctaggcagggaccaccccattgaagagatgcctttgggttcagtcccagtgggaggagcaagaggactgtaagaagatgaggacgaggagccatgtgggaggaggaggggccacttgtgggacgaggaggggcccct

SEQ ID NO: 412957 - DNA, 668 bp, Homo sapiens
cccaccaaccccacccaccacaaaccaacacctcccctcgcacctgccctccctcttttatttaatctccgacgccaatatcaccgtggtaagcaatgcaggtttgatagcaacaccagctcagacggtaattccacaggacgtaccggtacctcagtcacatctttgtcatgttcgaagctgctaggaaaggctagcagaagactcaccagaaaggttctgaagatacaaacaaagagcctgaaatgttggaaactttagggtcaagcattggtattagagccttggaaagagaatagagttgtcagtcaatttacattacactggaaactataataaattgggcaaatgcaatgcaaagaaaactgctgacagcagatatgttcctaaaatgtatgtagaatgatgtagttgttaatttaattagttgcttaaagccagacaatttctttccaaaaattctggcctgtcaaaagttaacgatcatctttcttaatctagcaaattaaatatgacactgaatgactttaaataacactgacacttccataggaatgttgatatgaagcatggtatttaattttttatgtaaaatatgaatgcacagaaagacatgaatgatgcatagtatgaaaacatgattcaaaaataaaaatatgactggtgaa

SEQ ID NO: 412958 - DNA, 631 bp, Homo sapiens
cccaccaaccccacccaccacaaaccaacacctcccctcgcacctgccctccctcttttatttaatctccgacgccaatatcaccgtggtaagcaatgcaggtttgatagcaacaccagctcagacggtaattccacaggacgtaccgaggaaaggctagcagaagactcaccagaaaggttctgaagatacaaacaaagagcctgaaatgttggaaactttagggtcaagcattggtattagagccttggaaagagaatagagttgtcagtcaatttacattacactggaaactataataaattgggcaaatgcaatgcaaagaaaactgctgacagcagatatgttcctaaaatgtatgtagaatgatgtagttgttaatttaattagttgcttaaagccagacaatttctttccaaaaattctggcctgtcaaaagttaacgatcatctttcttaatctagcaaattaaatatgacactgaatgactttaaataacactgacacttccataggaatgttgatatgaagcatggtatttaattttttatgtaaaatatgaatgcacagaaagacatgaatgatgcatagtatgaaaacatgattcaaaaataaaaatatgactggtgaa

SEQ ID NO: 412959 - DNA, 770 bp, Homo sapiens
tattaggtccatcctgctggtaacttcgttctgcacattttctatgtgtgtaaggagattgagctgccactgaagatatgaagttgatattaaatcacagaggactgcacttactcggatttttcatcaactgctaacctactaacgttgctcattaagcaaggcaagctctagcactaggagcagattcaaaaagagtaagacagcgttctgaggaactggtgcaggaagagctcctccacaccttcagcgttcctgcccacccaggagaagaaacaccattaaggacatgtcatgggaccaattcaccacatgcctattatttgagaaaacctagttatttcctgcctggaggctgaagttaaattcaatatgcagaatatgctatctgaagatcctctagcatagaagaaggcaccaagtagacagcatggtggattgagagtcaaaaggcatagatttcatctcagtctgcctcatcagtaaaataaaggcatcacaggtagtgttctaagaccccacctgctctacaatgagtcgaatatgcagaactgccaggtcagtagcatgcaagttcataatgcagatctactccgattgccacaaataagcctagctagaaatggatacagaggaacagaggctaattaattcttctccaggaaaaagtcacacctcttcccttccagtaggatagtaattttgttgataaatatatgctaatgtatttgtctaagtaatcaatgtggaaaataaaaatgtaacagtga

SEQ ID NO: 412960 - DNA, 567 bp, Homo sapiens
ttaagcaaatcatggaaataagaaaatcagaatggattatttcaagcatgagaagcattttaccaacatttacatttgctatatcaacagtttctattgggtggcacttctaggaattttgatactgacagcagcttcgaacatgacaaagatgtgactgaggtaccggtacgtcctgtggaattaccgtctgagctggtgttgctatcaaacctgcattgcttaccacggtgatatctctcttctaaaaaagaaaagagagagagaaacagatgaattccccagaaacttctttttagctgtagactaatcacctgcttgatcccaaaatgtgagacgagttccatttcccatcgcttgtcctgcttccctccattaaaaatagtaggtatttgagctaacttctctcagcacatcattttcacaacttctctgtaaaatgggaatgatttccctggtgactttgtaaattgtgttttattgtttatttctatttatgtcaaagaaagataatgtgaaattgtcaaaacttgctaaatgtaatatacaaataaatgttggtaatta

SEQ ID NO: 412961 - DNA, 832 bp, Homo sapiens
aagtctggaaagtaggttgggggcttacctcagaattcgtgtccttttaccaggtttattcactgttggccccagaatcctttcagaaaccaagaaatgagaatatgtcaagggttaaaggaggctttcacttccagaaatcagaagtaaaataaaggcttttagagcctgaaattagctttttggaaatgataggattataaaatcactggcaaaagggtttagaacttgactgccctataaagagttcttcctctgtgccataggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaagg

SEQ ID NO: 412962 - DNA, 480 bp, Homo sapiens
  misc_feature (3)..(3): n is a, c, g, or t
  misc_feature (12)..(13): n is a, c, g, or t
  misc_feature (16)..(16): n is a, c, g, or t
  misc_feature (31)..(31): n is a, c, g, or t
  misc_feature (36)..(38): n is a, c, g, or t
  misc_feature (48)..(48): n is a, c, g, or t
  misc_feature (65)..(65): n is a, c, g, or t
  misc_feature (71)..(72): n is a, c, g, or t
  misc_feature (82)..(82): n is a, c, g, or t
  misc_feature (84)..(84): n is a, c, g, or t
  misc_feature (88)..(88): n is a, c, g, or t
  misc_feature (90)..(90): n is a, c, g, or t
  misc_feature (96)..(97): n is a, c, g, or t
  misc_feature (110)..(110): n is a, c, g, or t
  misc_feature (113)..(113): n is a, c, g, or t
  misc_feature (129)..(129): n is a, c, g, or t
  misc_feature (131)..(131): n is a, c, g, or t
  misc_feature (139)..(139): n is a, c, g, or t
  misc_feature (150)..(150): n is a, c, g, or t
  misc_feature (155)..(155): n is a, c, g, or t
  misc_feature (177)..(177): n is a, c, g, or t
  misc_feature (191)..(191): n is a, c, g, or t
  misc_feature (195)..(195): n is a, c, g, or t
  misc_feature (209)..(210): n is a, c, g, or t
  misc_feature (246)..(246): n is a, c, g, or t
  misc_feature (250)..(250): n is a, c, g, or t
  misc_feature (284)..(284): n is a, c, g, or t
  misc_feature (296)..(296): n is a, c, g, or t
aanaaaaactannaanaaaaaaaaaaaaaanaaaannnaaaaaaaaantaaaaaaaaaaaaaaanaatatnncttaaccatntnctantntaaaannaaaaaaaaaaaantanaagaaaaaatttaaantnaaggaaanaacaaaaaccnaatanataaaaaaaaaaaaatcttttnaaaaaaaagaaaangaanaaaaggccaaaaanntaaaataaaaaacatccattataatctaaaaaaaangtanaaaaaaacaaaataataaaaaaataaaacatttnaattccccaaanacagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412963 - DNA, 9028 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttaaaaaaaaaaaaaaaaaaaaaaaaaaatttttgggcggcctgggcccggaaaagaagctttccaagaaccattcggttggggcgggccccgggcccagagtatgggttatgttgcacctgggtcacataagccggtctcccagagagaaaacctggccccaggactgagtggccgtggcttttctccacaaataaaaaaaaggccgcgggcgcgcaaaccggaggggtctggaaacaatttcaagaggtggctcggaggcccatacacggggctccacccacgcgggagtccaaggcaagccgaaataaatagcgccggggggc

SEQ ID NO: 412964 - DNA, 8650 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctctttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412965 - DNA, 7822 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412966 - DNA, 8736 bp, Homo sapiens
ttgagaaacgaggtctagggttggcaggcaatacaatacaactcttgatgcctctcattcctctgtcaggctccacaaggacactttaaggactaatttgatttaaatcaattcattaaaaaatatctatagcttttagctagaagaaccccaaggagtgattattttgcaatagggctgagttgggccgggcatggtggctcacacctgtaatcccagcactttgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412967 - DNA, 8567 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412968 - DNA, 8567 bp, Homo sapiens
ggtgtggggagccggggccggcccgggacgcgggctggggagccggggcgaggggcgacgccccgccgcccgagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412969 - DNA, 6915 bp, Homo sapiens
caaacctaaaaattttttatcttagtgtatgacagttacttgtagagcatataatagtgtctaggataattctggttctagatctttaattttgcaaacttcaagaagaagcttatcattgttttcttcaaaaataattgtctaacctattgatttatgacatactggagttgtataagaaatgtgttggccaggtgtggtggcgcacacctgtaatcccagcactttgggaggccgaggtgggcggatcacttgaggccaggagttcaagagcagcctggccaacatggtgaaaccctgtttctactaaaaatacaaaaattagctggatgtggtggtgcacgcctgtaattccagctactttggtggctgaggcatgagaatctcttgagcctggaaggcggaggttgcagtgagctgagatcgggccactgcacactccagcctgagtgatagagtgagactctatctcaaaaaaaaaaaagaaaaaaagaaatatgtgattaagatgtgttatataatttaatacatgccaatatcaattaatagttttttactaacttagatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412970 - DNA, 5879 bp, Homo sapiens
aagtctggaaagtaggttgggggcttacctcagaattcgtgtccttttaccaggtttattcactgttggccccagaatcctttcagaaaccaagaaatgagaatatgtcaagggttaaaggaggctttcacttccagaaatcagaagtaaaataaaggcttttagagcctgaaattagctttttggaaatgataggattataaaatcactggcaaaagggtttagaacttgactgccctataaagagttcttcctctgtgccataggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412971 - DNA, 284 bp, Homo sapiens
aattattttatccaaatcatttatttctctctgttgttctgactatccaaagctacaccatcaattttatggtttttctgttctcaaatactgctgggacaacttaacattttgatttaagcatttgataaataggttgtatgtatttttttctctgcgtgtttttagatcagcaggtcaaaaggtacaagattgttacttctatcaaatttttatggaaaaaaatgagaaagttggcgttcccacaattcagcagttgttagaatggtcttttatcaacagta

SEQ ID NO: 412972 - DNA, 275 bp, Homo sapiens
gtaaatactagggcggtgggtgtggggagccggggccggcccgggacgcgggctggggagccggggcgaggggcgacgccccgccgcccgaggttagtgaatgagcgggcggctggcggccggcgggcggccggatcccctcggcgcagccgcctggcctcagggcgtccggagccgccgcggcgaccatcgggccctcggcgccggcccgttagttgcccgggcccgagccggccgggcccgcgggttgccgagcccgctgacgtcagcccggg

SEQ ID NO: 412973 - DNA, 3520 bp, Homo sapiens
ggtgtggggagccggggccggcccgggacgcgggctggggagccggggcgaggggcgacgccccgccgcccgagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaagg

SEQ ID NO: 412974 - DNA, 3118 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaaggtgaccatcttaacttatatgcgttaaaaataactgaagagcatattcacatgtcaaagtattagctgaaatgtgtgtctgtgtagttggggggttttcttttaaattagaaatttctttttatgtgatatatggttagctcctctttttgtaaattcttcctctcttctaaaagtgattgatgatgtggaataatgaactcctttaagaagctggctggttctagtatattaaatgcttaaataaaaagtcctttcctttccacctagcaatgatattctcagttgtttctctcttgtggtgcagagttgcattgggttttctacattttcccactgagtcttccctgttgtaaaagggagttagaaagctgctaactaggattaagtttatagtcagggaacagtgttataatctcttcctagctaatgggcttactcaaagattcaccacctgactttgaatttgtcagcagcatactgtaaacagctgtaatgttcagaggcttgcaggaaaaaaacagagcatacttcagattgtactccatttaccttaacccctccaaaggaaataacagctatttcattatgtgcaatgtgttacaccctttcaaatgtaataaactcacaacaaaattgaaacataatacttgattataacttattaaatgtcttttatgtttttcctttgtcaggaaaacttgaaaactgtgcttttaattgaaataatattggatgaatgaaactgaattcagtattaaaatttgactgttagaaatgaaaaataaaatgatttaaaaattttgcctg

SEQ ID NO: 412975 - DNA, 8763 bp, Homo sapiens
ttgagaaacgaggtctagggttggcaggcaatacaatacaactcttgatgcctctcattcctctgtcaggctccacaaggacactttaaggactaatttgatttaaatcaattcattaaaaaatatctatagcttttagctagaagaaccccaaggagtgattattttgcaatagggctgagttgggccgggcatggtggctcacacctgtaatcccagcactttgggggccgcgcgtcggagtttccccctttctagggtgaggatggttctacacagccacccggagttccttagttgaaaggtgcgccctgctgtgacaggcattttgatttcctttctttttacagcatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412976 - DNA, 8891 bp, Homo sapiens
  misc_feature (8841)..(8841): n is a, c, g, or t
  misc_feature (8883)..(8883): n is a, c, g, or t
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggttattttacagatgaggaaactaagactcagggaggtgaaactactgcccaaggatagccaaacaaaatacacgtcagaagtgggatgtgaaacgaagcctgtatgtcaccagagtcacctatcctctccccctccaancatctaaccacaccagggagttggcaggagattcttagccanccttaaat

SEQ ID NO: 412977 - DNA, 8704 bp, Homo sapiens
tgcggttcggaggcggggcaggtgggggcgggcccaggtagcaggtttggctgcgcgggggccgcgcgtcggagtttccccctttctagggtgaggatggttctacacagccacccggagttccttagttgaaaggtgcgccctgctgtgacagaatgtggtaattgtaatctttaacattttcatgtaaaacatatttcctgatcatctttccattgtcttcatggaaaattgataaatatttgtgccttccaactctcgtcttggttgaatgacttcatcttaatacaacatggacaccacgttgctgaaaacatgctttgggactgccactgaatttatcttttgcggttttatgacaaagttattagtagtttcccttttttgaattagtattttgaagttaatatcacaatgagttcaggcttatggagccaagaaaaagtcacttcaccctactgggaagagcggattttttacttgcttcttcaagaatgcagcgttacagacaaacaaacacaaaagctccttaaagtaccgaagggaagtataggacagtatattcaagatcgttctgtggggcattcaaggattccttctgcaaaaggcaagaaaaatcagattggattaaaaattctagagcaacctcatgcagttctctttgttgatgaaaaggatgttgtagagataaatgaaaagttcacagagttacttttggcaattaccaattgtgaggagaggttcagcctgtttaaaaacagaaacagactaagtaaaggcctccaaatagacgtgggctgtcctgtgaaagtacagctgagatctggggaagaaaaatttcctggagttgtacgcttcagaggacccctgttagcagagaggacagtctccggaatattctttggagttgaattgctggaagaaggtcgtggtcaaggtttcactgacggggtgtaccaagggaaacagctttttcagtgtgatgaagattgtggcgtgtttgttgcattggacaagctagaactcatagaagatgatgacactgcattggaaagtgattacgcaggtcctggggacacaatgcaggtcgaacttcctcctttggaaataaactccagagtttctttgaaggttggagaaacaatagaatctggaacagttatattctgtgatgttttgccaggaaaagaaagcttaggatattttgttggtgtggacatggataaccctattggcaactgggatggaagatttgatggagtgcagctttgtagttttgcgtgtgttgaaagtacaattctattgcacatcaatgatatcatcccagagagtgtgacgcaggaaaggaggcctcccaaacttgcctttatgtcaagaggtgttggggacaaaggttcatccagtcataataaaccaaaggctacaggatctacctcagaccctggaaatagaaacagatctgaattattttataccttaaatgggtcttctgttgactcacaaccacaatccaaatcaaaaaatacatggtacattgatgaagttgcagaagaccctgcaaaatctcttacagagatatctacagactttgaccgttcttcaccaccactccagcctcctcctgtgaactcactgaccaccgagaacagattccactctttaccattcagtctcaccaagatgcccaataccaatggaagtattggccacagtccactttctctgtcagcccagtctgtaatggaagagctaaacactgcacccgtccaagagagtccacccttggccatgcctcctgggaactcacatggtctagaagtgggctcattggctgaagttaaggagaaccctcctttctatggggtaatccgttggatcggtcagccaccaggactgaatgaagtgctcgctggactggaactggaagatgagtgtgcaggctgtacggatggaaccttcagaggcactcggtatttcacctgtgccctgaagaaggcgctgtttgtgaaactgaagagctgcaggcctgactctaggtttgcatcattgcagccggtttccaatcagattgagcgctgtaactctttagcatttggaggctacttaagtgaagtagtagaagaaaatactccaccaaaaatggaaaaagaaggcttggagataatgattgggaagaagaaaggcatccagggtcattacaattcttgttacttagactcaaccttattctgcttatttgcttttagttctgttctggacactgtgttacttagacccaaagaaaagaacgatgtagaatattatagtgaaacccaagagctactgaggacagaaattgttaatcctctgagaatatatggatatgtgtgtgccacaaaaattatgaaactgaggaaaatacttgaaaaggtggaggctgcatcaggatttacctctgaagaaaaagatcctgaggaattcttgaatattctgtttcatcatattttaagggtagaacctttgctaaaaataagatcagcaggtcaaaaggtacaagattgttacttctatcaaatttttatggaaaaaaatgagaaagttggcgttcccacaattcagcagttgttagaatggtcttttatcaacagtaacctgaaatttgcagaggcaccatcatgtctgattattcagatgcctcgatttggaaaagactttaaactatttaaaaaaatttttccttctctggaattaaatataacagatttacttgaagacactcccagacagtgccggatatgtggagggcttgcaatgtatgagtgtagagaatgctacgacgatccggacatctcagctggaaaaatcaagcagttttgtaaaacctgcaacactcaagtccaccttcatccgaagaggctgaatcataaatataacccagtgtcacttcccaaagacttacccgactgggactggagacacggctgcatcccttgccagaatatggagttatttgctgttctctgcatagaaacaagccactatgttgcttttgtgaagtatgggaaggacgattctgcctggctcttctttgacagcatggccgatcgggatggtggtcagaatggcttcaacattcctcaagtcaccccatgcccagaagtaggagagtacttgaagatgtctctggaagacctgcattccttggactccaggagaatcccaaggctgtgcacgaagactgctttgtgatgcatatatgtgcatgtaccagagtccaacaatgagtttgtacaaataactggggtcatcgggaaaggcaaagaaactgaaggcagagtcctaacgttgcatcttattcgagctggcagttctgttcacgtccattgccggcaatggatgtctttgtggtgatgatccttcagaaaaggatgcctctgtttaaaaacaaattgcttttgtgtccctgaagtatttaataagaagcattttgcactctagaaagtatgtttgtgttggttttttaagaagtctaaatgaagttattaatacctgaagctttaagttaagtgcattgatcatatgatatttttggaagcatacaattttaattgtggaagtttaaagcctcttttagtccattgagaatgtaaataaatgtgtcttctttatggaccaaggatatgaaatcatttttcttttgtagctaacggttgccttgaggaagaaataatttggttttattaagagtctactctcaatccagttattagagatgtactgagtttgatttgttaatcctttctatatactgctgatcttgcatgtctacaatctgctcagtttttctgtgtttctgcaatagtggtcagaaaaatacttaaattcccttaatggtgttgttttctatttgttctggttttgagataaatgagtgattctgtccccaaatgtccatttttgaagtgattttcctggaggattagggtatttagcagttgaagctcttcattcatagtagttactgtcagctaacaggttttttaaggcttttaactattaatattttatggaatggggcaaagtaaattgatgaaagaattggagtgataatagtcctttacaaacatacagtccataagaaaatgaatttggcatatagaattattacaatttcctgggagagatggatatttaaacctctattattttagacaagactgtctagaacttaagtttgatctgtcagccagtactcccattaaattcagtgtagtttcacttgatagaatcagatatgttatcgaaatgttagcagcagcttcatcctccttctgattaaagtaagtagaaatgggatgttttgtttaataacagccatagtgtgtgtttagaccacagcggatgttgtagaccaggaccatagatgatacatgtcagtgctgtggaatgtgcattctctgagtgttgttttgtggtatcattgtctttcctgaatgactttctaactgtgcagaaaggcagaaaagtcatcatatgtatatgtcatatgactttataaaatatttaatgtgacaaaaagtggaaagaatctttacaaaccctgcaattacttttttaaaggcacttttactctttggttttatcattccattttgctaatatttactagctttataaattacagtaaggtacaaaaactcatcttgtaatattttcatttttgaagtgaaaaagtacatatattttgcacaaggttttatactgctaagtgcttggttggggtggtgagatgatgattagatcaggggtgaggctgagagactctgggtttagggctagccctgcctccatctcccttgggtaaaatgaagggtgtggggtaaaagatgcataaggccttttctagctctgacagcctagaagtccaatcaccctgtaataaatatgtgttgaatgaagaaatgggtgaatgagcttgtcaatgtgattttaaaaaattgactacctggaggaatgattaggaatctaaatgaagccagccctcggtatctgcaggtttctcatccatggattcaaccaactgcaaatggaaaatacgattttttttaaaaaaaggatggttacatccgtattgaacatgtacagacttttttcttgtcattattctctgaacaatacaagaactctttatgtagcatttacatttattaggtattataagtaatctagagattatttaattaaaatatacaggaggatgtgtgtcagttatatgcaaattctgtaccattttgtatcagggaattgagcatcttcagatgttggtatctgcagggatcctggaaccaaacccctgcagatactaagggctgacgatctaggtaagactggatttaacagttggaaaaaaaaaaaaaaaaaggagagagaagacagttcctttcctgtagaaattaaaacaaaatacaaattgaggaagctctgctacccaggctgtcatggtagagaacttgaagaagacctgtttggatggacacctggtttcaaaagtcaggtgtggagactgttaaatgggagggcctcatccataaatgatttctggcaacgtcttcttcaggtggagcttgacgtctttttaatgttacttggggagggagtgctcattaagggatgccagggccagctctggtggttcctggggaggctgcgtccttccctgcttctgcatgtcatgaggcagcaggaaggtttcccctgcacctgtctgtcctggctccctctgggtagccccctactgttctgtgcttcagcacagcctggtttgtcaagaggcacatagttggggctgggctgcatggcacaggggcttatgtgcctgctggttatttaattttcagccttaagttttctttaatattttcctgttggctatttaaaggttttggttatcttttattccttatctacaatcaagatgacaatgtaattgaattatcttatttataacacggttcgtgattcatgattcatgattacaagtagaaaatatgtcatgttcctcacctccaaataaatatgtgtgtgtctgtgtgtgtgtatatatgtatgtggcggagagggagagagtggggaaggagagcagtgttatcatacatagagaggctaaatgtgtcccatccctcactgtcagctttataaaggagtttgactccatccacagaagaatgttttataagactaggaaaacacgttgaaaactaggataaacagcaacaaaaatcaactaaatatgttgttactgttgctaaggattttctccttagaataatttaggatttttaaaaatttctgtttgccaaatgctgtagataaatggccagattcttcctatccctaggattcctttattattttttttcacagattttgagaacaagggggagagatagtatggaagattaagattccattaatcttatagaactgtgttgtcacccaaattcctgcttgtttgaacatggcatcttcatagattcaggattcactaccctctatagctggatcttgaaaattatctggccagataattttgcatctgcttggatgattgtagactgagatgtgagtggaggataaagtattagacttttgctgagtaactgccaaccaagaagtatttatcggacacttactaggtgcctaggattgtatcagagggaatatgaaatgtgtccctgccctacctagttttaacgacagaatatctattaaaggctacttagctgaagggtaagggtgacaggtctaggggaagctttgggaggtggtgtgctgtgacagaaaaagtggcagagtagggacgagagacctgcattctagccctgtttctgtcacttgctctgtacacttagacaacagcttgacctcttgagctttagtttcctcctctgcataatgagagggttagactactgaattgtatgggaaaaaaatacaaattcctgggtcctaggccatgcctgctgaatccgactgttcaggaagaggcctaggaaatctgtgagggaatccccaggggaatctcgtgaccagccaggtgtgaaatctgctaactggaagatctcaaagcttccttcactttttgtgattttgtggtcatgtaacgttactgtattattctacgtaaatgtgggtacttggatgtttatcatactgtttctctgtgtttacatactaatttgtgtaagaaatgcattttagtctgtgtacctcaacctgctgtttgtttcctagaggtgttagtagtctttaaatacaagtaagacttaagaggatatttgatgttatttacctggatattttcttccccttttatttatttagaggaaattgagattctaggagccaaaaaaatgaaaacaaaattctaaggcaaagttaaagaaaaaaattacattatttcttaccatttgctactttataatgaaaatttaaaaattatatgggaagatttttctctgggataacaaatccttgtcataaagtaagaggtctttttaaagtaggtaggctataaggcctgtaatttaaaataatactcctttctctagggtttggtgcaattctccattaatgaagataacatttgaattccccaaagcaggtgaggagtcggggaggagaaagcgatgttaaaatgaaaactcactgcaaaagaggaggcagaggaagaaggaatgtaaaccccttaaagcagatgtgtgtggggccttatgaagaccaggattctgcgggtgtcaggggattgcccctcttgacagagactagggttttagactgaggcttcctgcagggtgttcgcattgcccttctccgttccccttcagacctttctggggagaagaggtgggaggaggggagaaagactgttcatcttattctgaatcctggagcagctgaaggttttctcttgagtcaggatgcagtggtaatgcattaaccagcaagtgtggccaaggataatgaaaaagtgggaaaggaaggtcctcctcctccctgattgtagcatccagcagtctctgtagccaggttactcaagaaccacatttgatttcctggccctttgccttggcagtgatggcatttttatttcactgtgttttaaagtcttcatttatttttataacatgggttagggagaagggccacaaatggagggattgtcctttcaagcaccacagcttcagataaaattagtactttcaaatattgtccactttaacttaaaaaattctagagggattatattggagactcaactgcccttggttttagtttataaaatggcctagtactgtggaattttaattttagaaagtcttagcatcagatcataaacattcattaaaagaactcacatcccatctgaaacttcccaggggagttgggattcttagtagattggtagaaaggggctcattttctactgcatttcccatttttggtatcttgttcagcatgttttatttttatttcttgtctgcagaacatcctatatttatgagaacattctttaagaagaccaccacatagaataccccttcctatcagctcgctctgatttagccttaattttgttaaattttttagagatgaatgaagtgctgctgtggaaagaaatgtacatatactatttctgtatcattaaaattacatttttatggtt

SEQ ID NO: 412978 - DNA, 305 bp, Homo sapiens
ttttctcagttcacatcttctggggtccaacatttgggaagaaactgatcaaaagcattccctgggtttggcatgactggactgagcttgcgcacataaagatcatcctttacaatgttggaggtgctggtacataggatggctgtctacttttgttgggtaaaaaacgattgaagggtaacgcagtctttggctcaacagccgaaatccttcgatacgacatatcatctttattataatcctgcatcttgaatgtaaattccgaatctgtgtcactttcaaaacctataaagaaggcacaagaa

SEQ ID NO: 412979 - DNA, 431 bp, Homo sapiens
ttttctcagttcacatcttctggggtccaacatttgggaagaaactgatcaaaagcattccctgggtttggcatgactggactgagcttgcgcacataaagatcatcctttacaatgttggttctcccttaatatgtgaacaaataaactgacagccaaaacacaacacaccttcacgcccccctctcaacgtgatatcagaggagcagcttgtcaatgacctcgagcccaaagagtccaagctttcaaaggaatcttctctcttatggtgccttggaggagcaagaaattctccacgttcaggacaccagatgtcaccgtagccactgtccctgccacttcttttcaggaagctggagtcttcgagtgcctaaagaaaacgttttttaaagaatagtaagttaaataaacttccaaaaaatataatcaat

SEQ ID NO: 412980 - DNA, 363 bp, Homo sapiens
aatggaagaagtgaaaaagaacaacacaaagaaaataaagaagtaacctctttcacccactgaaataatctctggaaaagatattagcaatcatgcagcttataaatatctaaagggctagaattgaggaatttataagaataaatttttttttcaacacataaaatacaacatgggaaataagatgttttttactaacaggcaaacacttgaggagtcctcttcaaagactacagtggatgaaagaacagttatccaaaggaaacggttagtagaaatataaagttagtcccacacaaaattaaaatgtgctcaatgcagattatctatcataaaacatttttaaagcaattatatttaaat

SEQ ID NO: 412981 - DNA, 388 bp, Homo sapiens
ctctaaaaactacccggtgcctgagctggaatctagacaattagaagtgcagccctgcagcccagtctttctccatggggcagggccctgggtggaggcaggacatctctgtggtctccaggctacagaactttgggcaaaccctctccctttctcaccctctgtctgcccaacataccagctgtgggaggctgggcaaaagagtgaatctctttgaaccccagtttcctcctctgtaaagtggggataaaattggtttaccctatgaggagttaatacatgctcacaggggatgatgtgagaactagaagtgaattcgtataaactgttcagaacagagcctggcacatggttagtgctaaataaatgctagttgttattgctgtta

SEQ ID NO: 412982 - DNA, 170 bp, Homo sapiens
acgaaagactctgaaatatatcctggaaattgtgaaccttggttctttgagtgacatcatttgttatttattctggctttccaagactgaccctttttcaaccctaaagtaggtgggatattttaagacggagaactgttttcagggtagggaaaagaaagaggccaatg

SEQ ID NO: 412983 - DNA, 1934 bp, Homo sapiens
ctgagccagtcgttcctgtcggaagggcgggcctgctcatcctggcgagaatttgcttttctgctttataggggattgcaggccaggcccactgacaggagcaccttgagaaccacctgaacacaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagca

SEQ ID NO: 412984 - DNA, 2012 bp, Homo sapiens
  misc_feature (2008)..(2008): n is a, c, g, or t
  misc_feature (2012)..(2012): n is a, c, g, or t
ctgagccagtcgttcctgtcggaagggcgggcctgctcatcctggcgagaatttgcttttctgctttataggggattgcaggccaggcccactgacaggagcaccttgagaaccacctgaacacaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaataanaatn

SEQ ID NO: 412985 - DNA, 360 bp, Homo sapiens
ttaagtggaataagcagtttaaaaacagtatgtacagggtggttttctggctatataaacacacaggcattgaaaatagatatacataaataatgttactataatttgtctgcctcccttctctcagaaaagaccaatgaattatctattatgtgccactcactatttgagtgctgggaatacagccccataaagtgaagtttcatatatcaggtagcaagatggccatggtctgtgttttgagaatcacaggcgtttttgaggctcatggctataatcccagcacttggggaggccgaggcaggtggatcacctgaagtcaggacatcaagaccagtctggccagtgtggcaaaacccc

SEQ ID NO: 412986 - DNA, 394 bp, Homo sapiens
cctctttcagcattgctgtgtgcagagaaaatggggatttagcaattaaggatttattttcttctgttcagctcatcacttgctccatccaggctaattagacatctcacttctttgtttccaagctaatttcagcaatagcagatttattagcttgtttaaacctcaaacaatgggtaaagcagcaagatatcccattctgctctgttgtttgaaaatatatttcaaactgagttgttcatccccaaagaccttgtcttttcataaatctagtgccgtggaaaatgatgcccaaagtgccgagcgtgtctgtctgaagagcgggggctgtcgggtctgctgtgcccgcgttctggctggcacattcctgcccggaagcggggcggggtacttg

SEQ ID NO: 412987 - DNA, 343 bp, Homo sapiens
ttatttttcccatttacagttggtgacacacccacagaagcctcaaacctgattcttgggcccaactcagccaaccctgtcctctcagccattcttaaaggcccagctcaaacaccccctcctccaggatgccttccgccaactcctagcattgttaataacgccctctcccatccctgtgttcctagagtcaaagatgaagtctaacctccttagctaaatgcagaaggccctttgtaatctgactcctactagagcctggcacagagtagcttcttactaaatgttttaagaattaaatactttgcccattccaatgagcaggatttttcctgtgaaccgt

SEQ ID NO: 412988 - DNA, 384 bp, Homo sapiens
tttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgtttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattat

SEQ ID NO: 412989 - DNA, 317 bp, Homo sapiens
gcataagcagaagcaccaaccagacagagtaacaatgaaactcactggctatccaaaagccaggggatgaaaaacaacaaaaatacaaaattttcatgatgatataataggaagctctcaaaggttggattcaggttctgcttttctgccagggacttgattgcttggatccatgcgtcagccattcgccggatccgtagtctcatccaccggaattcttcatgctttttcatcatactgtagagaatattaaaatctgtacgaatttccgcctagcaacagaaatttaataaaatgaatagaagataaaaagtcag

SEQ ID NO: 412990 - DNA, 793 bp, Homo sapiens
cagcatctctctccagaacctcttcttggggacccctctctgaagcctcttcttgggagcagctttctggaggaaaacgggcagcatagttgtgctgttgctgatggttggagatgtggaaatgcttcatgcagggatccagggggtctgctcgcaccgtgatggtgaccggcttccgaatacccagagactgcctcttctctactgtcacaacatcaatttcttcattctctgtccgagaaaagagatcaagagaagaaacacatcccatgagaaacacaaacatagaccctacagctttagctgtctacgctggtgcttgggaaggtcgcctgccccacctccttccctggactagaaggttagatttgtaatcataggtcggcgaagctgcaggaacttcacaaaggtacaagcgaccatttccaaactacctgcaccagaggcagagactgggcagcagaatgtcccagatatggggctcataacaccagagacctggagacacctggacacgcccttctcattcactggcttgaaggtctcttaggttaacctaaccaggagaggggcaattgggagaaaagtctcctcctgctccacacattttgcagcctccacacagaagtccaccttaatggatctcggcctcgcaaaggaagagctccgttctcagcttctttgcatatcaggaagcttgagcccctttgtcaggaaggcttccattgtgtggacaatcgcattatttctccattaataaacctgaccattcagccctcctggccccaaagcc

SEQ ID NO: 412991 - DNA, 885 bp, Homo sapiens
tcctctaaaaggtgcctcttgcatggtggcctgacatgtcaacgtgcccaggagtctgtgacaggcagccaggtgcctcaatcccactgcctggggggccagggctgggctgggactcaccatattctggaagtcgcacaaactccgagggctcgctgggaaggctgattccccaggggttactggcactgactctgaactgataaggacacccgggactaaggtcttcgatgacgaggcctcagcctcccactctgtaaaatgggattgatcatccctgtctgggtgatcgagcatgttaagtagggatacatgcatgaagacaccttgaaacctgccctgggtcataaatatgtcagggaggtttggatcatcttagccaaaacagctgctcgacatctgggatcagaaggcagctgtaatctggcactgaggcctctgtgctgagttggaagacacaacaaggaacaacttctgaaagatgaggaggctaatatgttcacaattctgaaggacctcctagagacgaagagaagacagaaaaacaagagcaggaggccgggcgcggtggcttacgcctgtaatcccagcacttccggaggctgaggcaagtggactgtttgcgctcaggagtttcacagcagccagcagcctgggcagcatagtgagaccctgtctctactaaaaatacaaaaattagccgggtgtggtggtgtgcgctttagtcccagctactcaggaggctgaggtgggaggttggcttgagcccaggaggtggaggctgcagtgagcccacattgcaccactgcactccagcctgggttgatggagccaaaccctgtctcaaaaaaaataaacaataaaaataaaggaaaataaaagtgg

SEQ ID NO: 412992 - DNA, 733 bp, Homo sapiens
attcacaggtacatgtggacgtttgttacctgggcatactgcatgacgccgaggcttgggatatgaatcatctcatctcccagcccctggcaaccaccatcgtactctctgcatctgtatgttcagctttttggattccatacaagacatcttcaaatcaattgatggaagattgagagaaagagaacttcaggtccaggtgctgtggctcatgcctgtaatcccagcactttgggtgactgagaatttcagaagagaaagagtctctcagcatttctcactggacatgcctgaagaagcatgtagtcttaattgctactgacatcatcccataaccacaatggaaaaggactggagatattgtctgagagctcttgttatgtgctaaccatcctgttggacaatgggaacaaagatatgagactccttcaaggaaggactcaagctaccaaaggtaaagctttgaaaaactattacaggcatttcttgaaaacagtatggaatcatctgataacactgaggtgatatgaatactcctttaaccggcaatgtggctcttaggaactgatgggcatgcacatcaggatatacacaaaagatttcccagcagcactgtttgtaatagccttgagctagaaacaataaatgtccaccaagagtaaaatgtataaaatatacaatggaataccagacatcaatgaaaatgaataaactataacaacatttacatggt

SEQ ID NO: 412993 - DNA, 318 bp, Homo sapiens
caagccagttatgatttgtcacgctatgaaaacattttctacctgttctgggttctggagcagcttcttcaaaaggaaaccgaagaaggcaacacttcaagtataggtcatgatgaccaagaaatcaagaaatttcttcagaagcatgatgaaactattttccaactttctgatgcatttcctttgtttactttttatttatggagagtgggcattcttttgagctcagcacagatagaaactcttagaaaataactccattccttagcaatttaccacgtttgaagcataataaagtagaatatatgaaaatctcat

SEQ ID NO: 412994 - DNA, 791 bp, Homo sapiens
ccttagggaccacacttcacaaaagggagcaagaaggcagataacggcaaagaaaaatgtttgtagtttactgtggaggaccaagtgagtttatacagatgtttacctcctttgggattatttgctgctggctagaatgaaaagacaaacattcccttcaaacagtatgccattgcctaataattttgcaagctcaaatgaaatccaaccaaattcagaatttagattttcctactggcttgtgtaatttttgtttgtatgggatagaatcaggttccatcttttattctccttcagaatatcattaacaaagaaaactttgaatgttagttggtgggatagatacattgacactgtttacatagcactgtttcctactcgggcctgcacacaaacattcgcacacattttcatgtacacacactcctggggaggtcaatgaatattacaattcttcttctggaaataatccttaagaatgaatgagcaaaagacacagttttcaaccctattttctcttctctttctctctttttcttccctctgttctttctctctctctcttttttccttctttttatttttttcttcctggagaggtttctgaagttcaacagtgattctttaattaagagaaaaaaaaaaccacacatacacacactagagaacaagaaggaatagtaaacagttccctccactgctagaggggttagttacaaaataaacatttcacagactggaccacatctcctgtaatgagacagctctggctagtgagactgcagctaaag

SEQ ID NO: 412995 - DNA, 355 bp, Homo sapiens
tctgtccctacttctgagatggagactgagtagggagtcaccaaactgatctggagaagatgaactagatatgctcagattatggaccctggcctcagtggggagaaactggaattctaacccaccagtccaactgtcatatccaattttaaactctggctgcgaaccatggctcacacctgtaatcccagcattttggaaggccaggcagaaggattgcttgagttcaggagttcaagaccagcctaggcaacatagtgagacactgtctctacaaaaataaaaataaaaaacatgtctggcagcagacttctcagtggaaagcttacaggccaggcgagagtggcatgacata

SEQ ID NO: 412996 - DNA, 188 bp, Homo sapiens
acattttatttcattcaatatcatgtgctacagaggttcaaattgctaaatatatagaccttagaaaaaattatatgaacttaagtgtaatgacggattcccacaatcaagcttagaagaataatagtgattaaggggtatttgaagtattactttttctttttaaatttaaaatgtattgctacact

SEQ ID NO: 412997 - DNA, 852 bp, Homo sapiens
tccacagtcaccgcctggccagccgtcgtgctgttgctgagctggggacagagaagaggcggatgaggaagggccacttgtgcagagaagggggcgcccacagagattgtgcgggactcatcaaagacatcaggactcttgtccagtggctcaaggatggaaaaggccgggaactaccggaaacaagcacaaaagaggcactcactgtcctggcttaggatgggggtacagaggctgtggtgtgtccgtgcctggcctgtaaggagcacctgccacgggacctgcaaaccctcaaagcagaagaaatgctgggcccctcttctctcttgagaaccctgtgatgatcactccaaggctccccgcagcttggaaagcatgtctgctcgggacaccaacccctgctgaggtatagccctgtcttcactgtaatgtaggcgttgagtccaacagaaacctggatgaggctcttcctgcacgacggtcagggtggaagaagccagcagtctgtctgcatcctgctttgctctggtatcattgctcctttcatcctgaccctcctatggtggctgtgttcctggctccagcctctctctctgcctctgtctccatctctctccctacatcacccagagcccatccctcccatctcatcctttacaagggattccccaggacctgccccttgtggatggcaaagttgtggctactcacagcattgacagccaggtccccgcggatgtctgctggcgtgatctcatggagcagagcggctccggccacagcccccagcagctgggcagccacgtagaaggcggctcggagaacggagacgtggcagcccaccaggcaggc

SEQ ID NO: 412998 - DNA, 4302 bp, Homo sapiens
  misc_feature (3100)..(3100): n is a, c, g, or t
cgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgtatgcacaccgcatgcttcctcatccacatagtgccagcagcagtgccacgcagttcctcctctccctcccggtgagctgctgccctgggcagaggggaggagaattccaggacaagagtgtcaaggacagggatttagcatatggaagtctttcctttgggtcagtattgaactagaattctaattcgggactgggcaattgagctgtataggggccaccttgcagggaggacagaaaactaacattttggcccaacttgatctatacaaaactttaataataccactactgaccaagttggacgtgtacacgtactcacactgccttgatggccattcgattggattcctcccaaatttcctaaaaagggagccgcgaagggcgctgggcagtgtggccgccaacttccaccccggcaagcccctctgtcctatgcagaagggcgctcnagggaaggaagtgtcgttgctgttagagcctcacgtggaggagtcacttaaacaccagttttttactgcttaattccttgttaggtcttctcttgaggctcttagaaaagcgttttccagagagatttctatttttgaacaatggaacggatcactgcttttttgccacatcacatagtaactgccggtccagaatgtgacggattcgactctattcattttcaaataaagccatgagccgtggaacattcttggtcctggtgcttgggttatgatggcaggagtcaagaagaagattactttcattctagaagaatgtagtttctctaattatttgaaatgttcatttagcctttgattttcactgatattaactagcaaactgctttaagtcagctcaaaggattatatagtaactatatctgcatttggagcaatgtgatcagtttgcatttaaaaggaaaaaaaagaattttatcttagccagaatgtccctggattcaggggtgtctttgtataatatgagagggccttgttccaaggtcaaggcagcctccttattttacatgctgtttgccaaatcttgtttcttagcttggggagatgatggacttagcttcctcaagataaatttctagtttattaagatgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaatgagcaccctgagccataaattgcttaataaacacattttgggtgattattccaagtttttatcagcccattgatacatgtattcatgagctctcagcattcccatccagctctgcagtgcattgaggcttctctttaatggtcaccactgtggtggtttttcccttctttctggggagaaaatggga

SEQ ID NO: 412999 - DNA, 2603 bp, Homo sapiens
tgcgtctttcaactgcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413000 - DNA, 3006 bp, Homo sapiens
cacgaggggaatgacaaggttgagcaggtcacatctgcggtgtgtgaggtgcagagtgatctaacgttacagatgaacgggggcaagtattcgccattggagatgatggagaactcctgtgcaatctcacctaccacagagagcacacgtccatttggattgaagtctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413001 - DNA, 2591 bp, Homo sapiens
ctagaggatcccgtgtcatcccccttcgtgtgtgtcatcccccttcgtgtgtcatccgaagcagtgcgaaaattaggagtacagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413002 - DNA, 4457 bp, Homo sapiens
cgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413003 - DNA, 213 bp, Homo sapiens
tatcacaactgtatcagagtcattcctgaggccatcgttaatctgcagatgctgacttacctgaacttgaggtaggttaaacataaaagttgtaatcaaattcagtgaaagaaataaaaaacttatgctttcatttctatccattttttcccctttttgcaattcttgatttttctttgatgtaggtcacacacagatgttttaagtaataac

SEQ ID NO: 413004 - DNA, 469 bp, Homo sapiens
ctgttctaatggctgccctcggaataggctgacctctgctctccgtgtgacatcctgcagttggattttcgtcacattcgaaagactgttgacactctgctggcactcggggagaaagccccaccaccaacttctgccctccgctccagggaccttataggcttctgtcttgtccatattctctttatagtgctggtctatatcacttaccactggaatgctctgtccgcataatgtctgcacgtgcatccaaacgctgtgctctgtcgccctcaacctttgcagggtccttcctacctttgagcctttgccttgcaaacttccatccctgtcatgtcttcagttatctctcgagttttgaagctgaacagtagcaaatcagattttccagaagcacaaactttgtagaatacagtttagtataattcctctcacttactgaaatacaacgacgacgactgcaaagtgt

SEQ ID NO: 413005 - DNA, 366 bp, Homo sapiens
tgcaaacagctctcatagatggctactacgaagaaaatcttatttttctgaacattttcatgaatccaggggacttgaaaatatggaagacccacatagttagaagaatatatttataaagattccttgctgctaagtcagatcagatttgctaacaggaagcattctttacatgacagtatcttgagttatgtgagttttttttcctcctgactttgtgttgattggtgaaatgcagggtatgtggaagttatctaattaacctcagttgtatatgaataacccacagatgtactgaattacttttggtgctatcttgtactcttcaatctgtaacacaataaaatccctttgtacgatgtctaa

SEQ ID NO: 413006 - DNA, 4713 bp, Homo sapiens
cgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413007 - DNA, 2712 bp, Homo sapiens
cgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaatttttcgagaggtttcttgagaccattgccttttaaaaaactattttcgacatacaaaatatttatataaatattatttattagtgagttgttattcatcctttggatgcaaattgtaaattaggaaactattttattactgcttttttgtggttaaacactttattttaatataaatattgagttattttctatcctctttggtgtgcggtagtttaggtctcagtaatgtttctggtatatatgattccaaaaaaaagcgaaaaacaggtgcttttaggacacaacttttctggggaggcaatattgacactttggtttgtggaacgttggtcttatttatatttctgcattccatccagtttcctacattccagcagccctctgtcccccaatataatgaactgactaaaatcaagagagcaccccaaagttatttgtaaatagctgtgatggaaaaaaaaaagacatattaaacttgaagctaaaatgtgaacaattattttttggattcatacttcttttgctatgcacaaaacattcacgttttaacacaaagaaataataagtgttagcatcgtgtgtcttgaagtatacttttgcactgtaacttgggttacgttaaagagagcttagcaccaaaggtagataatgaagaaatggcataggaaagtggagatgataaaaagttgattgttgaaccaaaaagggtttgaagggaagcttcgactgagtatcagaaattacttaaggcacataggacctgaatcaggaaaccagcacttcttacaactgccagttttaaaagaggaaatgattctgagatgtgctcattttattttaatttggtggttggtggttttccaagtagtctgtaaaatcctgcaagattcacagtctctggtgtgaaacctcagaagtgagtcgttgtgagcctgtgggcagcaccaccaaggcaggctaaggggagggtgcagtaagtggagtttgtgaggctgagtggctgaggagggagcaagtgcaacaaaatagggctagagaagaaccagccaaggagtggaacccatgctgctctcagagattcacggaacacggcagccttctgcaggcagttccatgcatgtgcactcacgctgcaatcacagatgtcccagtaattaacctttctaagtcttgtgaatgctgactgcactttcacctcctcgaaaagccattggaagtttttagagcagcagcagccacagtttgtaagacaaatgtagagggggacgcaaaagaaaagacaccaccaggaggaggattcagtgtgcagtcagcacagaccaacatcaaccaaggcaatggctgccctccactcttgggaagatggggggaggtttctgaaaacggaaatttggattggcagctagcagttatttcctatcagatgtactgtgcactttaacctaacttaaaatgtattttaatatttttctgtactgcacaaatacctgttttgtcaaatagcataatgatgtaaagaaacattttggacaaagagtgtatacaatttaagcaacattcaaaggttgactatataagtaggagtttagcctgctgcaccttcacgggcattcagaatgcggggtcctgaaatattttcttacgtgtatatatggtagcatgaagctttgtaatcattgttttgagagatttttttttcaaaattaaagtatttcttttgatattaatttttattattttcttgaagttggttgtgtaatgtaaatggcttcagtcttctgtaaaattgcttttttttcttttaaatgcagtccttctatggctaagacgtcttcaagatccttgtacactgtttatatgtgcaataaaatgcatggccagctgacagtatcgtcagtggacagaatgtatatagtgcaaatatccttccttttattatttaacagccattaaaaccttggatttgtacaaacca

SEQ ID NO: 413008 - DNA, 2799 bp, Homo sapiens
cgcagtccttagcttcccggggacaggaaaccttcaagaccgagctgccacggccgcctccccgcccgccccccattctacgcgcctgcccacaccctcctcccctccttccagcgcctttcggtggagcactgcggcactcagcccgagctgccgttttcccctcgcggggaacgctgtgacccccccgcaggagcggcggggcggggtgggggggcccgggagaagatggcgacgccgggaagcgaaccccaacctttcgtcccggccctttcggtagctactctgcacccacttcatcatccccaccaccaccaccaccaccatcagcaccacggaggaaccggcgcccccggcggggcgggtggtggcggcggtggcagcgggggcttcaacctgcccttgaaccggggtctggagcgcgcgcttgaggaggcggccaactccggggggctgaacctgagcgccaggaaattgaaggaatttccccgtaccgcagcccccgggcacgacctctcggacacggtgcaggcagacttatctaaaaacagactggttgaagttccaatggaattgtgccattttgtatcactggaaattcttaatctgtatcacaactgtatcagagtcattcctgaggccatcgttaatctgcagatgctgacttacctgaacttgagtcgaaatcagctgtccgccctgcctgcctgcctgtgtggtctgcctctcaaagtcttaatcgcaagtaacaacaaacttggatcattaccagaagagataggtcagctcaaacagttaatggagctggatgtcagctgcaacgagatcacagcgttgccccagcagataggtcagttgaaatctctacgagaactgaatgtcagaagaaattaccttaaagttttaccacaagaactagtagatcttcccttggtaaagtttgacttttcctgcaacaaagtgctcgtgattccaatttgttttagagagatgaagcagctgcaagtgttactacttgagaataaccctctgcagtctcctccagcacagatttgcacaaagggcaaagttcacatatttaagtatctgagcatacaagcatgccagattaagacagctgactccctttatctccacaccatggagaggccacatttacaccagcacgtggaagatggcaagaaggattctgattcgggagttggaagtgataatggagataagcgattatctgccaccgagccttctgacgaagacactgttagcctcaatgtgccaatgtcaaacatcatggaagaagaacagatcatcaaggaggactcgtgccatcgccttagccccgttaaaggggaatttcatcaggaatttcaaccggagccttcccttttgggtgacagcaccaactcaggagaagaaagagaccagtttactgatagagcagatggtctccattcggaatttatgaactataaggcaagggcagaagactgtgaagagctgttacggatagaagaggatgtgcactggcaaactgagggcataataagttcatccaaagatcaggacatggatatagcaatgatcgagcagctgagagaagcagtagatttgctgcaagatcccaatggattaagcacagatattacagagagaagtgttttaaacctatatcctatgggatcagcagaagccttagaattacaagattctgcactgaatggtcaaatacagctggagacatctccggtgtgtgaggtgcaaagtgatctaacattacagagtaacgggagccagtattctccaaatgagattagagagaactcccctgcagtctctcctaccacaaacagcacagctccatttggcctgaagcctcgatcagtgtttctaagacctcagagaaatttggaatctatagacccgcagtttacaatccggaggaaaatggagcagatgagagaagagaaagagctggtggaacaacttcgtgagagcattgagatgagattgaaggtcagtctacacgaagacctgggggcagccctcatggatggtgtcgtcctctgccatctggtcaaccacatccgcccacggtcggttgcaagcatccatgtcccatcaccagcggttcccaaacttagcatggccaaatgcagaagaaatgtggaaaactttttggaagcgtgccgaaaattaggagtaccagaggaaaagctatgtctcccccaccacatccttgaagaaaaaggcctggtcaaagtgggcattaccattcaagcattactagacatcaccgtaacgaaggctctgttcacatgaaactaccccttctccattgggggctcagactctgctctcatccaggatcctgaactctgctccaggcacctgttcaaccctctctcccacccactgcctgtcacttcactgactccagttacattgaaacaattttcagtctaagggaggattttctacctttcagagctgacctccgactttaagacttgacaggtatttatcttgaaaccagagagggagctggaggaaaaaaaaactgagcagcacatcaatgccttttccaccctccttcatcctttccacactcaccgactgccattaccaaaacgccaagcacaaccgttttgcagcaagacgcattcgttttattaaaaccaaactcattatgtatttagtggggggaggggggcacaatcaggtttttcaccaccaaattttttgggaaggattccctggtaacgtgtggccctttcaaaaaacaaattttacgggcctgtc

SEQ ID NO: 413009 - DNA, 801 bp, Homo sapiens
tgcatacatcattaagtgaaggtggcatcacactggcagggaaagtcagatgggttattggcgaagaatgaaattttgctgatcttcataaattgtgaaatgataaaaaacaaatagaactcagtagaaatgaatggcaggccaaacaaaccggacagaaaaggggctacagactaaaagtggtaaattacagcttctacacataaatcctttttaccccaaccctctttaaattctggaacataaatgggggaacaaatatagaccctttctaaatccacaccagagaagtgactttggttgtttttttgtttggttttattttgtttttctgatataatagtgatttttgcctcctttcctcctctttgtaaggtcttgggtagaagaggttgtaaaagaaaatgaaactatattatactgatgataatagctaccattcagtgatagttattgacagatgttaatatctgtttcatagagcaaggattaaatgagttatacatagaacacttaaagcagtgttttatgtttataagcatgtagtatttaagtattagatattattatctttaatgttggcaattgtcttaacaatataacagatattctactaagcactatatatgtcttatctcacttgctactgttatgttaattttatagatagtaatctgaggcatgggaagtttaaaaagttgcctgagattgcacgggtggtaataactgcgcactttctatatgctgtacttagtactagacatttttaatgtatcgttgcatttagacctcacaacaata

SEQ ID NO: 413010 - DNA, 715 bp, Homo sapiens
ggattggggagccatcaatttataggtgatgataattgaaacagtaacatttaaccaatttttgcaaaggaaaaactataacggattgaacattgtggtggcaggaatcaaagaacagtccttgataacctagggaaacagagaatgtgtgtgttggccaagtgaaccacgtaaaaataaggaaaaacgtagaacacttaaacagattttcagtaagataattcttattatagctactgtgtgctgtgataggagaatacaccttttcaagattgaagaaaattgactaaatactaggcaacaaacaaagactcagattccaaggagtagaaataaagtaggatctgtcacaatgcagtacaactagaaattaataataaagatcagtaaattaaagttccttccacctggaaaatttaaaactcttaagcaactgtcttagtacattttgtgctgctataaaagaatacctgaggctgggtaatttataaagaaaagaggtttatttggctcacagttttctgtaggctgtacaagaagcatggcgtcagcgtctgcttctggtgagggcttcaagaaactactcatggttgaaggagagcagacttcacatggcaagagaggaagaaagagagtaggaaggtgccaggctcttttaaacagccacattgttagtgaactaagagtgagaaatcacttattattttgaggtggc

SEQ ID NO: 413011 - DNA, 718 bp, Homo sapiens
ggtggaatctctgtatttttaatttgcatgtttctaatgactaacagtgttgaatgtcttttcatgtgcttatttaccaaccgtatatctttgatgaagttcctgttaaaatctgttgtacatttttatttaaattgggtttttttgttattcggttttgggaggtttttaaaaatgtgttttgaatacaagtttattatcagacctatgatttgcagatactgtctcctgtctgcgcttatctttatatatatctattcttcacagtgtttttggagagcaaaagtttttaatgttgatataggccaatttttaaatttgtgtattgtgcttttgatgttgtgtataagagctcttgtctaactcaagctcacttaagattatctcttatgtattctcctagcagttttatagttttaggtatcacatttatacttatccatttggagttagtttttatatatatcgagagttatatattgatgatttttttttgcatgtggatatcctttgcacctttatcagatatcagttgtccatacagatgtgtgtctatttctggagtatctgctctgttccattgatctgttgtttttctgtctttgcactgatctcacatggtcttggactactccagctttatagaaagtcttcagatttgagagtgttggtccttaaactttgttcttttaaaagttgtttcggctctttcatatcc

SEQ ID NO: 413012 - DNA, 2066 bp, Homo sapiens
ggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggacctgcaggggacccggaggctcccacccccacctctcaggactctgcctccaccacccccgtgggcatgcactgaagggttgcctgcagggtctccaggcgagggggaccccacagggtgggcagcgccttctcccggcttccccacagtcccctgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtctcacctggggcctccatcccagaagcgcagggcttatttttctgattaaagaaaataaaaagtgccgtgccactattttttataacagcaaaaaa

SEQ ID NO: 413013 - DNA, 770 bp, Homo sapiens
gccactcctgggtcagcgcagctggccccagcggtcacttctgggcctgaaacagccctgccagccccggcggtcacttctgggccccggtcagccctgccggccccagcggctccttccatccccagatcagctctgccagccccagcggtcacgcccggcccagccctgccggccgcattgggcactcccaggccccaggcagtgctgcaggcgcctgcggtccctgctgaccccgtgtcaccactgccggcgcctgcggtccctcctggccccacggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgg

SEQ ID NO: 413014 - DNA, 2350 bp, Homo sapiens
ggtccctcctggtcccctgcctctactgccggcgcctgcggttcctcctggccccaaggcaccgctgcaggcgcctgcggtccctgctgaccctgtggcaccgctgccgacccctgcggccgtgggccagcccgtgtcactgtggccagcccggtagggcatcctcaggacagcgcagccggcccctgtggtcgctgctagcccagtgccagcggtaccagcccccgcggccactcctcaccctccgaccacgccgacggcccgccagcttcctcccaggacagtgctgctgcccccggcgggccttcctagccccgtgtcagtacggccagccccgaaggtccctgctgggccagcccagccgcccccggcggtcgctgctgcgccccaggcagccccagcggttagtggaagccccagagcagcccggcccactcacgccttcactcctgggcccgggacggccgaggcagcagaagcagccgctcatgggcccggagcagccctgcccacccaagcggccgctcatgggcccagagcagccctgccagcccctgcggccgctcatgggccccaacaagccctgcaaaccccagccgttgctccccattcccgatcgcccttcactcctggggcagccgggcccaccctgccggcctctcctggggctcctgtgccagccgcggcggtccctattggatctggtgccggcccgtcagccccggctctcgctcctggccctgggccatccctgccggcccctgcggtcccggtggacccgatcctgtgcccccgggatggcccgtcaggccccatctgtgagccctggagcctgatgcctgcaggcacctccccatatgggttttccagcccactccagtgtgatctgcaccctggcagggccccaagggccaaggccgcattgcccttcgggctggagatgctttgccggactagcctgaggccttgtctagacagggctgagctgtttgtcgttggaaattgaggctcggccagaggcgggagcccctacagtgccacgatcaggctgaggctcaccacaccaggaagagagatgaacccgcgtctgcctgccgccccgccatgctccctctccccccactggcgtcacagtgcccccacccgcgttgctgcctgtggtgtgcgtgccctgggaggggaacacagcccctgagggcggggaccttgctgggggcccctcagcgtctttctgtgcctctgaattgccaatactgtccttgcatctctgagtctacgtgcacgcttgcccctggcgtgccacctgtgcggagcgcgtgagcctggtgtgtgcgtgctgtgtgtgcatgtgtgcgagagggtgtgagagtgagtggcgtgctgggcatgaaggatctgtggggtgctgcagttcctgcagagtggcccagtggcgaatggtgaaggtgtgggtttcagtccaggccctccccctggtagtcaggaggtgctggtgtccacctccagggcccccaagctacagggggcacatgggcccatctggtgggtcaggacctgcaggggacccggaggctcccacccccacctctcaggactctgcctccaccacccccgtgggcatgcactgaagggttgcctgcagggtctccaggcgagggggaccccacagggtgggcagcgccttctcccggcttccccacagtcccctgcagcgtcccgtctggctgttgacctacatgtggtcgggcacacctcacactacaaggctacccctgggcccatccctgccccttccacggcccccacctgtggtcaggtgttgccaccccctcaggacctggtctcaaggcagccccactcgagtcttctggagtccaaggcacgccactcgcccaaaagggagggggtgtttgggggggctttgactgtctccagacctcaggggagctgggcaggctctaaccagtggtcctccagagagcagcgttgaccacctggacccctgcgccacgtgacaggaggctctggtcctgcaggcctggtcttgcccagctgggccgcctcaggtgtcaggaaggggatgggtgtccctggctcccaggccaggcagctgctgacctccagcaccccgcacttgctcatgaggaccccacccccgcaggccctcccgggtcctgaccagcctctggtgcagcatctgctttggcctccgggccccctcgctccccacccacccgggccccttcctccggtgctcacctggggcctccatcccagaagcgcagggcttatttttctgattaaagaaaataaaaagtgccgtgccactattttttataacagcaaaaaa

SEQ ID NO: 413015 - DNA, 419 bp, Homo sapiens
  misc_feature (3)..(3): n is a, c, g, or t
cgngctgcaggaattcggcacgaggtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaag

SEQ ID NO: 413016 - DNA, 313 bp, Homo sapiens
  misc_feature (3)..(3): n is a, c, g, or t
  misc_feature (298)..(299): n is a, c, g, or t
cgngctgcaggaattcggcacgaggtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtacatganngggcgcacgctcaa

SEQ ID NO: 413017 - DNA, 620 bp, Homo sapiens
aatactcaaacgctacttccatacacgacagcagttttcagaaatcatgtcttagaacattcaggctgctatagcaaaataccatagactgggcttatcaataacagaaatttatttctcatggttctagaggctgggaagtcctagatcaaagcatggtaaattcagagtcagaggcagggctcctttcctgactcatggatgggccttctttctgtgtcctcacttggcggagggagccagggagctctctggggcctctttataagagcactaatcctattcataggtcacagggctccactctcataacctcatcatctcccaaaggccccacctcctaaaaccatcactctggggatatggatttcaacgtgtgaattttggggggacatgaatattcagactgtagcaaatggttctgacttatagtttctcttcttcccaatcacttcctatgtgccagtagacagtagagcatgtagaattcttcatgattcctaatatcctatgcagtgtgcaaacccttcttagcagatgtgtgtaagagtgcagaagtctaacaacagaccagaagcagaccattgtcagtctgcccctgggactcagtattcctcatg

SEQ ID NO: 413018 - DNA, 344 bp, Homo sapiens
atcatatgctgaactgcctgaagcatgaactttgcattgttgaattcctataccggtaggtcccgtcacccacctcttgatgtcaacatgcaaacacaggccctatggtgtgataggtcccactgaagtgtggaaaactacaggcagttcataaggaggcatctgtgactacatgacatctaattgtgcatagaagcaggtaatgagactctttcttcttatgagccccaggtaacaccaaggaaaaaattgtttcttctacctaagcccccttgttatcttggccacccaggcctgagagaggttcaaaggcatgaaacttctgggaggtagcagggatggct

SEQ ID NO: 413019 - DNA, 863 bp, Homo sapiens
gaatgggcaaaaactggaagcattccctttgaaaactggcacaagacagggatgccctctctcaccactcctattcaacatagtgttggaagttctggccagggcaataaataagatttttatgagaaaaaattctgtaattctgaaaagaaaaaacttagaagagtcacaatatgtatttatgttagcgttcaactcaacagaaaatgactagatttgcatatctccctctgtattcagtctcttatgctatcctaagtcatataacctctggacaatttcactgtatacttgtgatagaatgagaatgaaaaacatagtgtctcagtattattatgaaaagagtttttgacttcatagctcccctgaaaggatctcagggacacctacaggttcccagaacaccctactttgaaaaccactagttaggatattggtatgtgtttttaaatcttctaattatgtcttttgtagttgccaataacattttctgtacactagagtatggatcagttattcattaaaacataatagtagagaagctagtgactgaaacttggaaaataggccaggcacagtggctcatgcctgtaatctcagcactttgggaggccgaggcaggtggatcacttgaggttaggagttcgagaccatcctggccaatatggcaaaaccctgtctctactaaaaatacaaaaattagcgaggtgtggtggcaggtgcctgtagtcttcagttacttgggaagctgaggcaggagaatcgcttgaacccaggaggcagaggttgcagtgagctgagatcgcgccactgctctccagcctgggcgacagagtgagactttatctcaaaaacaaaaacaa

SEQ ID NO: 413020 - DNA, 315 bp, Homo sapiens
ggtaatgaggtatgtggtagatatgcagaaaagtgaatcatgctctacataaataattcattttgaattttaaaaaattatatttatgattaataacatggggtcaaccttaaaaacccatatttcaataattctggaatttgttaaagaacattcctatcgggacagttagattaaaaagttaaaagcaacttgcgtttcccacaacctgccatttcagcacaggcagagaaagcaacttagctattttctatttttttaagttaaaatatgacttttaatgttaaaaagtcatgcctatatctaactgactta

SEQ ID NO: 413021 - DNA, 665 bp, Homo sapiens
cagggaagtcattctcaggatccttaattgcagaagctactcatttgttttagttattttcccatgtaggttgcataaccttgaggaaagggcatctagtatattatattgttcccataatagttaaatgactctttttaggaatcctgataatatccataataattattattcatactaaagcaaataaacaagcaacccactatgtgcctatctctgtgctcaacaaaacattatcacattttgatcctcacactaaactggttttgttctgtaattggttcatttggttggttttgaagacgtgcatgtaggcaagttgctttcatcttgttttatgatgaaggctcatcagtcaccttgtaaatggccgtaagattgctgagctgaagctcaatgatggagggaaaagacctcaaagtctaataatggatgagggcccttgttatctaagacattgactagaaattgagttcagtctttggtcaagaagagtcttgtctgatcataatgaaaacccaacccgattggggttgatatctgaattctactttaacatctgactgtagtggctggataatttgccttcctttcccttctttcatccattcactcccctcaccctacctcacccaccccatcttaatttgtattttgaatttgag

SEQ ID NO: 413022 - DNA, 671 bp, Homo sapiens
gggcattcaagtctaggatattcaaaaacaactgcatatatgggaagtattagaaagtgactgctcatgcccagggaaaggtaaaggctcagaaaaaacctgagaagactaagtttacacctcaggctcatccttggtacaaaggcagtctctagcaaaaacctacacacagacacgcaataacgaaaagtagcaaacaccagggaagaagaagaatctgatttctagagttactacattattagatccaaatgtccagttttcaacaaaaatcacaagacatacaaagaaacaggaaaatgtggcccattcaaaaaataaataaattaactcatattccttgaaaaagacctgatggcaggtcaactagataaagacttttaaacaacagctatcttaaacatgcttaaaaaattaaaggaagatgtggagaaagtaaaaacaaaccaaaaacaacaaaaaagatctagaaacaaaatggaaatgtcaattaagagatagaaaacctaaaaacctaaaggacaatggaaatggtatcaagtatgaggaacagaaagagaaagggttgaagaaaagtgaacaaggtttaagcgacctgtgtgactccatcaagaggaccaacgtacgcattgtgggagttccagagaagaagcagagagagagcatatttg

SEQ ID NO: 413023 - DNA, 696 bp, Homo sapiens
ggtccagagaaaatggaccagcctgtaagtgtcttagcagaggccagatgctctgcaaggagttcctgtgaaatgagagctatacttttcagaccacctctagctgaatacatctaattgggagttgcaggtgcatgggaaataaaatttccctcactggggaatttgctgcagtgaggatggctctattaaatcagtgaggaagcaaacttccaggacttggacatacttacttaggctatacactttgtaggctgggcttgctctaagagccagtcctgagatgctttctggcctgatggttttcaacaaagccactatttttctttctctcttcttccctgtgtctctcattccttgcacatatactgttctagagatctaaggttttctccaggaatactcttcttttacttttgttttattcatttaagagacactgctaaactctgggaatacagcagccctccgtgcaacttctttttgttcgtttttaaattgggcaacacctaattccataaaatagaatgagtgtttctgagacttctattttagtcaaaatcttgccatcctctcttaataaccaatataggattctgttacagagagattcagaatagtagacttctggaccttggatgtcactgagtttaagagaaaggtagtcccaggactctggtctagcagctgagtaag

SEQ ID NO: 413024 - DNA, 659 bp, Homo sapiens
ggtctgcgctgtgcctttagtttttaggttgggcccctcctggggagcacccagctggaggagccaggcaagtggcagaggacaccttccgactccttggaaagggccaggaagcgatctggatcctaggagagaaaattcctacgtggaacatgtggtgttctggcccttcctgggtagacacctgcagaggccacttggccctgccgggtcagaagccacaaatctgcccaggcctttgttttcactattcctgaagtttttctgctgtggcccagcacctgccctggcacctgctcggcatctgctcattggcaagccccggacggagttggactggcctagctgagaggtttaggagggcttccgctggcactgccaacagggagtttggcttggtctcccaaaaaaagggcctttgagaaggacatgtccaggggcagacacgaaatccactgatacgcaaaacgaatgtaaacccttttctttcctcacatcttgtggcccttcacacctctgcagttcagaggatttggaatggaaggcctcatccatccccagtcccaaagcaaacgtgggagccagcttgggcgtcttcttgcaggctgctggggctttgtgtgctctgagagaagatgtctggtcctctgcctacccca

SEQ ID NO: 413025 - DNA, 887 bp, Homo sapiens
gatctggcaaacactagtattccacaaataccagatcctggtgatgctaatgatgatggtaatgatgtgggtgagtattttgaaggcaaaaggacagaagtgggaggagaacagagacacccatgattaggtgggggtagagagtgtgagttagggagaaatagctgctgggacagatggatcataacacatgttcgcttgtcttcattcttccgcctccaggttttaaaaggttctactagtatcacataaagtgtccaaaagcttcactgatgatagttgtctccatcaaatcatccagatggcttattccccccttcttcatttcccgtgaccatggaaagacagacactctccattttattgtcatcggtcacctaactcagagtgaatggggtggggctggagagggagataaggggtagttaggttaaactaggacgcagatttgaagttctgaggatgtgccagacttaatgtaattctcgcgacagctcttggagacattctgttggtacacaaaccggaaagtgtgaggacacgatcatgtcgtcatgtccctgtcctccttttctttgtttattgcccctcatctagctccgatttggacctcaggagaggctccagtttctctctgagcctaaagccttttcttttttctttccttctattttattttggttaaatttctgatattaacagttattgaaaaggacaaccaaaagtattatggttggtggtggctatttgagaagaaggaagtctcttaagtggaaaattggtgttaacgagggggtcgctgtgttaggtaatgggatgggaagcacggttaagaaagagaggggagtatggagaaatgggggggagacacggggagtgggtggggt

SEQ ID NO: 413026 - DNA, 703 bp, Homo sapiens
  misc_feature (1)..(1): n is a, c, g, or t
nagagagctagcaccatgagcttcaataccctgtggccttggacactggcatgctggtctaggatcctctacgcacaacgcctgctcgcctcctccgtgtggttgccaagccaagccgcctgctaccttcatcaccaaattgcactcgctccttcctggaatcctttttcctagcttcaccacagactcagagagaacccaccatggtgctgtctcctgccgacaagaccaacgtcaaggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccacctccccgccgagttcacccctgcggtgcacgcctccctgggacaagttcctgggcttctgtgagcaccgtgcttgaccttccaaattaccgtttaagctgggagccttcggttagccgtgcttcttgccccttgggcctccccccagcccctcctcccctt

SEQ ID NO: 413027 - DNA, 662 bp, Homo sapiens
ctagcgtcagagccacctcgcctcgcactcgaaggcactctccaggtttgagattcaggttgctgtcgaccagaccacaagccatgattgagtccaggaggatgttcccgggcaggcgcaccagctgtcagaagactccaccagactcagagagaacccaccatggtgctgtctcctgccgacaagaccaacgtcaaggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccacctccccgccgagttcacccctgcggtgcacgcctccctgggacaagttcctgggcttctgtgagcaccgtgcttgaccttccaaattaccgtttaagctgggagccttcggttagccgtgcttcttgccccttgggcctccccccagcccctcctcccctt

SEQ ID NO: 413028 - DNA, 643 bp, Homo sapiens
aactcgcacaacatgatgcacttgctcaagaaccactgggctgctctactgcttcaggaaggacatggacaaggtcgagacattcctgcgcatggtgcagtgccgctctgtggagggcagctgtggcttctaggtgaccgagtagcatcctgtgacccctccccagcccggccggccgggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccacctccccgccgagttcacccctgcggtgcacgcctccctgggacaagttcctgggcttctgtgagcaccgtgcttgaccttccaaattaccgtttaagctgggagccttcggttagccgtgcttcttgccccttgggcctccccccagcccctcctcccctt

SEQ ID NO: 413029 - DNA, 490 bp, Homo sapiens
  misc_feature (1)..(1): n is a, c, g, or t
nagagagctagcaccatgagcttcaataccctgtggccttggacactggcatgctggtctaggatcctctacgcacaacgcctgctcgcctcctccgtgtggttgccaagccaagccgcctgctaccttcatcaccaaattgcactcgctccttcctggaatcctttttcctagcttcaccacagactcagagagaacccaccatggtgctgtctcctgccgacaagaccaacgtcaaggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaggttaagggccacggcaagaaggtggccgacgcgctgaccaacgccgtggcca

SEQ ID NO: 413030 - DNA, 725 bp, Homo sapiens
  misc_feature (1)..(1): n is a, c, g, or t
nagagagctagcaccatgagcttcaataccctgtggccttggacactggcatgctggtctaggatcctctacgcacaacgcctgctcgcctcctccgtgtggttgccaagccaagccgcctgctaccttcatcaccaaattgcactcgctccttcctggaatcctttttcctagcttcaccacagactcagagagaacccaccatggtgctgtctcctgccgacaagaccaacgtcaaggccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccacctccccgccgagttcacccctgcggtgcacgcctccctgggacaagttcctgggcttctgtgagcaccgtgcttgaccttccaaattaccgtttaagctgggagccttcggttagcctttcctctgccgttggcctccaacgggcctctccctcttgaccggccttcctggttttgataagtt

SEQ ID NO: 413031 - DNA, 583 bp, Homo sapiens
  misc_feature (34)..(34): n is a, c, g, or t
  misc_feature (36)..(36): n is a, c, g, or t
  misc_feature (61)..(61): n is a, c, g, or t
  misc_feature (115)..(115): n is a, c, g, or t
  misc_feature (118)..(118): n is a, c, g, or t
ggattatgtcggccccgtttgaggagcggagtgngngtggtaccgtgcgggaccccgtggncagttggtaccagaccttggaggaggtgttcattgaagttcaggtgccgccagncgncgccgcctggggtaaggtcggcgcgcacgtggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggccaacgtggacgacatgcccaacgcgctgtccgccctgagcgacctgcacgcgcacaagcttcgggtggacccggtcaacttcaagctcctaagccactgcctgctggtgaccctgggccgcccacctccccgccgagttcacccctgcggtgcacgcctccctgggacaagttcctgggcttctgtgagcaccgtgcttgaccttccaaattaccgtttaagctgggagccttcggttagccgtgcttcttgccccttgggcctccccccagcccctcctcccctt

SEQ ID NO: 413032 - DNA, 342 bp, Homo sapiens
taggttaaaatcatcttactataggcacattagaactaccaacatcttatccctgaggaacaagtacagtttggagaacattaagataaaagtcttggctttgccttctggggcaaataaggttattagctgatttttcttcttttcttggttttgtttttttgagacggagtctggctctgtcacccagactggagtgcaatggtgcaatctcggcagactgcaacctctgcctcctgggttcaagcgatcttcagcctcagcctcatgagtagctgggattataggcacgtgccaccatgcccggctaatttttgcattttttagtagagacagttttgc

SEQ ID NO: 413033 - DNA, 744 bp, Homo sapiens
ttataacaacatctacaataaaatattattgtgaaaattaaatggtgtaatatatgtaaagttcttagcacagttccttggtctggcacataatggataatcaaatgataatattactattattattattattattattatattggcattattagagccaactccatcattcctagaaaactatacagtgctggttcctttgcagtgttaactttttccttttactgatttttgttaactcctttattgtaacataaccactagtagttttgtgcttaatgttgatcttctttgtctattgatttaagttaatatcagagtccttcctagcagtcatggggttttgataacagaagctaacatagttgtatcttctctttcctgcagggtagcccgaatgccatgtcttcacattttattccacttggatctcctgtagaatggctgtttaccatggaagggctgattccaattctcacgttaatcacttacaaggcagaaaccagctagtctagactggtaaagggctttccagttcattcatcagcctcctctgattctctcagggctcattcagatgttcccaatcctttcacaagattacaattcaacacatatggaagcacaaaaaaaaatgctgatttccccacataaataataattaattactaatgaagataatggtgacagactatgggacttaagaaaaaacctacgaggatgtatcacaagacaaatccttct

SEQ ID NO: 413034 - DNA, 656 bp, Homo sapiens
gctattttccatatctcataatttctctttgttcttatgattactatgatgtttaaagtcaatactgttcacaaagtttggtttcttaggttatgctgaggtactgagtcagaaaaatcatgtcttactaaaattgagacagaaatattcttcacacctgatcaaaatgccaacttggctttatgacctcaggcatgagtgtctctgtttatgaacatttttaaaagacagtagttttgcttttaatgaacatatttagataccatggttaagattcaatttgcaaaatagagtgcatttccaggtttgggagtaaaagatgcccatcaatttcattattttgacacagtgagaaattgaatcaagcaattactttcctttgtgcctcaggttgaagctggccaaggaaatttaagacacaggagtgatttgaaaaaaaaaaaagaaacaactccttagagctatgaagataatgcacattgaggcacatttattgtttgaaaggtcacattgtaaacataattccattattagacaatcccagtactgttaaagggaccatcaaacactctgcaggcatggcccattccaacttgtaaaattagaataacttagaagaatgagcttttataacataaaggaatttcctgcagatt

SEQ ID NO: 413035 - DNA, 561 bp, Homo sapiens
atattaatggtaagcaagggagatatatcagcttgaagtttatatgaataacatcccctggagtcacgcagttcattatgtagagaccctagaaatgtgcaagtagtaataactgagaggtgtaatacagttgtttaccaaatatgtaaagtggctgtgtgtactcatcactggaatcctttaaagagaaatcccaagctttgaaaaatactgagacagctactcttctttcatgtctctagtaataatcaagtgagcttggatcagccaggtagggcagagtttcacctctctttatggctgctctagtaagtagacaaaccgattagtttcaaatcgatgatatggtgatatttaaactagtcagcttataattttagtttaaatgttgtctgagaagaaattaatgttgctgctaccctgcacagccttaaacctctttaccaaaattgtgaattcaactcatttggggctttcttcatgcaatttgccgctttattagtttttataatatgctttgtgtgattgagtattttctctgtaaaacctaatgattaaaga

SEQ ID NO: 413036 - DNA, 1010 bp, Homo sapiens
tcttttaaaagctggatttactgggttttttttttctctcagtttaaacatcttaacagagaatttgttactgtttattaaaagaattgcatttggaagcaagaaaacaaccggatttgcaatcatgtgaagaaacaataatgcctttattatcaagtgttaagcacaattcttataacaaactgtgataaattctttttgtttttttttcctttgccccattattttcttatgaacaaaccaaaaattcatggtgagcagttgcagtgttggctgatatatcttttatgtacagggaatttgaaaaggacagtggattcatttagaagtgtaactggtgctgtgattatagcaatacatttgttagttgtacttcatctttttcatgctagctttttaaatgtttagttttcctcttgtcatggtcagctgctgaatttacttgaaggatgtagaatactgtttaaaaaatactaaaatttgtacaattagatcaaagaattgtgcaatcatttcctttttaatttttaaaatgttgaggctcataaatatttgagaacatcagatctaatagagcatagtgatactatttaatttaaccaaagtctctagtgaatatttcaactttgaatgtaaactaacaaataaacctgaccaccaaggagattgtttgcccagagtttcaaagcacattgtctacaaatggaaattgaaataatttataaaatattgacgttactatgttttttaaaaagttcctaattttttctccttctaattcgacaagctgattctaaaatttatctgaaatgggaaatggctaaacataaggcagttttagaaaataatagtgaatgaagggactcatctgtccagttaagacttacatattaagaaagtgaggtagtgatagagagaaactgagacaactcagacaaccgacgtcgtacatgctatatgcattcttgcacgtaagatagaatcagtcttacagtcagtgaggcccacat

SEQ ID NO: 413037 - DNA, 616 bp, Homo sapiens
gtggagactctgtagccggcctgggttcaaaccccacttctgccatttattagctgttttgatgtcatttaacttcgtgtgtgtgtgtgtgagtgtgtgtgtgtgtgtgtgtgtgtgtaacagggtctcactttgtcaccacactggagtgcagtggcacaaacacggcttactgcagcctctacctcctggactcaagcaatcctcctgcctcagcctcctccacaggtcatcgtgggcatcacaaagccgtagcacgtagacgatgccggtggcataaactatatattatcttttgtagtagatgatggtggtttcggtgacgatgtatcaccacgagggcggtgcgtctatgaactttcggtgggtaacagaggacaaatctctccgtgtcgtcgggctcctcccaaagggctgggattatgggcttgagccacagtgtccaactcatttaacctttcttatgccaatttcctcgtctgaaaaacaggcatcacatgtgattgtaccaaatgaaattgctatttttgtaggtcagaaacagttaaatattgacagtttcataaggtatcagcctaataatggcacttacctggtagggttgttaggaggatta

SEQ ID NO: 413038 - DNA, 553 bp, Homo sapiens
ggattcttcctaggcttcaactatatctaagcattccaggagtcaagggcacagcactaaggcaggaacttgaaacactcactgagaggttgtctgtgtgtagcccctcccacaggggcttgttatacacctccttagggggaaggaggggtaactccaggtaggcaagtgtggtttccaatccctcacaatgatacctttgctctggctggtgctacatagggcagggtctcctgctgaggcaggggcaggatccagtcctttgagttttcttggatggcatctcaggcttgtccctgctgccctgtgggctattagatcacttcctgacatccctcaagagtcctctggagtggggcttgcagggctgagcctgcagctgacttgtctatgaggaaacgcctcctctgtctctggtccaggatctgctacttatggaggcccaccccaacccagcacgtttttaaagtacgttggagctgcccaggagggtgttttggcaatacctcctttagaggctgattctgaaatcagcgtgctttagaactgccag

SEQ ID NO: 413039 - DNA, 1050 bp, Homo sapiens
acaaccactttgaaaagtggaatactgtcctacttgatgaccgcttggcaccaactcaatcgcaaatataaacgtagtaactcatgcacccaggtgatctagagcatccttgtgtctaggtttttacatgatcataaaaggaacatttcaaatgaagacccctgaggcagtgtctgaggacttcattttgaggaatacaaaattgattttgagaaacaccagactgtgtaacttttacttctctgtagcttacatgtaaattccggcctgatctggctagcctacctctgccatactatctcttgtcaccctacccacttttctacaaaattgatgtgttttccttaaacatatcatgtcctctttttttctctctgagttgtctgtgttccctcttctttttcaccagactttttgagactcaggtcagttatcttgtagtgttgctgtatcttccatcgtacagtggaatggcatcttacagaaggggtttcggtcctatggttagcttaatgttgaagtcagggaaagtcaaaatcaccattggaactcccttcaactgtctataaaatacactatgcacagtaccttggtttacgtatatttgcataaatacatactttgtatagtcacatgttgtatgacaacttactgagttgttcgatgaacaactctatgtgctaataataatcttgatgtattaaaatgggaaagcatttgcttaactgagtggagaggcacaggttgctgagtcagacgtatctcctgttgcacacgtaccttcaggatggacttgctgaaggaaatagctaggaagatttatgtctaaagttctgtcctattccagttcacatgagcaagtgataactttataagaagattatttacccataaatcaaacaaaactttatattaaatttttaggagaaataaagtcagtcacaaatgaagaatgtaatttaacattttgggctaaattttttttttaatgacaatacagatatcctgtcctgtgtgaagcatttttattcagtcttggcctatgttttt

SEQ ID NO: 413040 - DNA, 1573 bp, Homo sapiens
cgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctat

SEQ ID NO: 413041 - DNA, 828 bp, Homo sapiens
attcatacactgaaaaaactctttgaagcccttgctgagagtacatcacagctgacctgtgcccgcccttgactccctccaaggtgctgatcctgagagccctccgcagtgaacaccctgcatgcagatctccttcttggaacctgttcctggaaaacccagtctccagcaacctgatatgtaactgcaaatctgcaactctagaccaaccttctaaagagggatttaagacctttttcaagaatctggcttgattttttggcccatggttctccctttattttactcaatgttctcaaaactaaaatggctctttaatttgattttcgtaaaatggaaatttggtagatcatattttatttactatgttgttaaaatgccccaatctcctcagtagattcatacactgaaaaaaaaataaaaaagaaaataccttattgagaaaaataggcaatctggtgggagtgcgagagaccacaagccatgagcgttagggattacgggcatcttaggaatataaagtgtaaggggccttgtggggcccaagagggggagcttcggggcccttcttcttaggggggggaagtaaaagacccgcgtactgtaaccgctgggggggggttgaggtgggggaaggttatctagttctataaggggggaaccggtatccaaagagcgggggaaacgcgaggagaaattgggcccaaggcgcctaaaggcccaaacccttaataggccctttttgtcgttttttatacgtcccccgcttaagacataaaaatcaagttcaagttgaggggcgaccccgaagagataacaccgacgttc

SEQ ID NO: 413042 - DNA, 1612 bp, Homo sapiens
  misc_feature (65)..(65): n is a, c, g, or t
cagagataatgaatatagagaacgcgaactttatagaaaagaaagaaaaccttaattagtacagnatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccata

SEQ ID NO: 413043 - DNA, 1344 bp, Homo sapiens
tgaccagcagcagcgaataaatctaaagagcagaaagatatgtactgtttctcccccatttctggtgtatgtctgcctccatgacagataatggtgagaatcatactatactaccaaatgccaggcaatggctggccaagtagccatttcccttcctacacagaccttaaaataataatcatccatcatgtagcacacaggggcaaatttggctagagttgatcgcagatgtacttgttttgggaatatatgaaagaagaaactgctgagcaggtcagtaaagaacagtccatttcagctgcaggacagttctctctccctgcatgcagggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccata

SEQ ID NO: 413044 - DNA, 2299 bp, Homo sapiens
cgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccataaaaaaaaaaaaaaaaaaaaaaaaaaaaaaaaaaaaaaaaaaaaaaaaaaaaaaaaggaggggggggcgcccccaaaaaaacccccacggggggccgcccaaaaaaaagagccacccccccttttgaggaaaaaagggggtccccactatgaaggaggcgcgctaataaaaccggagagagacgaggagcgacacataataaacaagctgtggacagagagaaacaagagctacctagggaggagcacattagtagagcagaagcccacacaatgagcgggggacgaaaaaaagaggggaaacaaacccaaagcgataacaaaccccgcaaggacataatacacgcagagaaac

SEQ ID NO: 413045 - DNA, 321 bp, Homo sapiens
  misc_feature (15)..(15): n is a, c, g, or t
  misc_feature (46)..(46): n is a, c, g, or t
taattattcctttcnaggaatatgtctgtctcagcccctctccccngtagaacacctcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccata

SEQ ID NO: 413046 - DNA, 460 bp, Homo sapiens
  misc_feature (65)..(65): n is a, c, g, or t
cagagataatgaatatagagaacgcgaactttatagaaaagaaagaaaaccttaattagtacagnatttatcagcgatgctggttagtattcaagaaagcttcaagcaaaggtccaaaaagactggagaaattttctgatgaacgtgctgcatatttcaggtgttatcataagtctctgctatgggacttatcatgttgttgtactccctacactgaagccccgagaggatgaggactggatctcattgtgtctcagacactgcctgatgcagaaagacactcattcaatgcttggggaatgtggggagagaagggaggggaagaagcagaaaacaggtaacagtggacgaagaggaagttctaccgatttattgttttctttaagtttgatgactaaattttcttagtagtagtgagattttctcaataaaaatagtcattgtgtgttacaactcatta

SEQ ID NO: 413047 - DNA, 1946 bp, Homo sapiens
cgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcgggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccata

SEQ ID NO: 413048 - DNA, 1036 bp, Homo sapiens
gcatccctggagggtggacggagagtccccggccgcgcgccggagaattgcgcggtggctttctcagccgaaacccgcgtctccggggctgtcactgtaaggccagcgtctagatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgcacgatgagtgaacgggccgccttcagctgagccccattgggtggccctgacttcgaagagcctacttgggcaggacatcacacaggacagacatagaccgggacacagtctacccggcttggcacaaggtttccagaccctcctgaaagcttccttccgagccaagaggaattttccacgcgtgacaagtattggacactgtagaaagctgacgaacgattggctaccacgcacgtgactgagc

SEQ ID NO: 413049 - DNA, 1838 bp, Homo sapiens
cgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcggatttatcagcgatgctggttagtattcaagaaagcttcaagcaaaggtccaaaaagactggagaaattttctgatgaacgtgctgcatatttcaggtgttatcataaggttacagaactcaataatgtgaagaacgtagctcgattgccaaaaagcaccaagaaacatgccatagggatttatttcaatgacgatacctccaagacttttgcttgcgaatcagatcttgaggctgatgagtggtgcaaagtactccagatggagtgtgtaggaacacggatcaatgacatcagccttggagagcctgacttactggccactggggttgagagagaacagagtgagagattcaatgtgtatttgatgccatctcctaacttagatgtacatggcgaatgtgccttgcagattacatatgagtatatctgtctttgggacgtccagaatcccagagtcaaactcatctcttggccgctaagcgccctgcggcggtatggacgtgatactacgtggttcacttttgaggcagggaggatgtgtgagactggtgaagggctgtttatctttcagacccgagacggggaggccatctatcagaaagtccactctgctgccttggccatagccgagcagcacgagcgcttgctacagagtgtgaaaaactcgatgctccagatgaagatgagtgagcgggccgcctcgctgagcaccatggtgcccctgcctcgcagcgcctactggcagcacatcacacggcagcacagcacgggacagctctaccgcttgcaagatgtttccagccctctgaagcttcatcgaacagagacttttccagcctacagatctgagcactgacagtaactgccaagaattgttaacacacttgtgatgtgtcagccacagattcacccaggaggtcacagaatgacagcaagggaaatgacgaccaagagaagaagcttaaagtcctggctaattgtgtggtcattggaaaactctgcaatacaataattttctttattttctttttcttttttaaattcttagtgtaattgaaacgtgctctatagatattgactctgtgttccctcttttacagctggacagaaagaagtcaatgtcacgaaatgattttctattgtagatactttgtcccttgcacttctctgaatctgtccttttgtggattcttgtgattttccttccaagtgtttcagttgtatgacagtcagtattgacaataaaatggcttttaattatttgttatttgtttacaccctattcctcagttattattactgtggttctgattaactactggaaattatatttgattatatcaccaattagttaaatcagtgcttcgactcactcttatctgttctgttcaaaactatttgttcaaagaacccgttagtattgtttacagggttacagtttctctcacatgctttcctcacccctttacccccctttttgaaagcctttattttgttcggagtctcttcataaaacatttgaaaataaaagatcattcttcacccata

SEQ ID NO: 413050 - DNA, 1144 bp, Homo sapiens
cgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcggggtgctgatcctgagagccctccgcagtgaacaccctgcatgcagatctccttcttggaacctgttcctggaaaacccagtctccagcaacctgatatgtaactgcaaatctgcaactctagaccaaccttctaaagagggatttaagacctttttcaagaatctggcttgattttttggcccatggttctccctttattttactcaatgttctcaaaactaaaatggctctttaatttgattttcgtaaaatggaaatttggtagatcatattttatttactatgttgttaaaatgccccaatctcctcagtagattcatacactgaaaaaaaaataaaaaagaaaataccttattgagaaaaataggcaatctggtgggagtgcgagagaccacaagccatgagcgttagggattacgggcatcttaggaatataaagtgtaaggggccttgtggggcccaagagggggagcttcggggcccttcttcttaggggggggaagtaaaagacccgcgtactgtaaccgctgggggggggttgaggtgggggaaggttatctagttctataaggggggaaccggtatccaaagagcgggggaaacgcgaggagaaattgggcccaaggcgcctaaaggcccaaacccttaataggccctttttgtcgttttttatacgtcccccgcttaagacataaaaatcaagttcaagttgaggggcgaccccgaagagataacaccgacgttc

SEQ ID NO: 413051 - DNA, 652 bp, Homo sapiens
ccagtgaactgtatgcttcttgaaaacagtactgtgtcttaatcatcttgattccacaatgcctagatggggccttttgcatagcagacattttgctaatgttagtggaatgaagtaattctctctgaaaagatgaatcataaatgcactactcatgagccagggaatttcctgagtcttttcttaaaacccaggtgaattcttgtggaaatatgactgtttctaaccacagtcatacatttccagggtataaagctggtaccattatgagacatttatatgtgtattatacaataaggtaaggtctgtcaagtgaccacaccacaatgcttggtggccagtaggcacacaatagatgctagcctttgtttcctttttctgattctcctaggttttatgtcagagtcactataagaattactaaggataggggaaattgcctttctgtttggacaaatattcatagcagttaaagattctgttttgacatgcccagatttagaattctgcaggaaaacagaagtcagagcagctggcaggctgaactggtacacaatataacccagacagtagacctgcccagtgtcacagtattttctgggctggctgttttagtcacaaggtacttgagaattttattcacatacacaaa

SEQ ID NO: 413052 - DNA, 683 bp, Homo sapiens
tgacgccccgctgcgcggtccaaccccttctccgacgcctggggacgtggacctggccgagggaagggagagggtaccggtccttggtgtaatcacgttttactctgctgggaaggcgtgttcatcttcccaccgaaacgcgccatagactggatcaggcgttttttgctcatcatcgtttcaaaaaacgtttactgaaggaaagaaaggaagaaggcaggaggagcgataaagagatagcaagagaaagaggatggaaagtggggaaaatgaatagatttctaaaggttgggaaagccttttagcagggagatgttttcctggaggtcttggaactctcttggtctcacagcctctgtaaaccgagggctgcacacctgtctctagtccccagctgatttccagaggcccttccagctcctgtgttgattcttctgcctcgactcacttctagcagacaagtaccatccagctgaccctggtaggcacgtggccacataatacggattgcacgagggtgtgtttcgtttttactaaattcttatgctacttctgagtgtttctgatttaaatataagcattggttctgctacttaataattatgcactcctgggggcagggtacttacatttttaagcttcattaattacctggcctgaaaatggggaaaataatagtatct

SEQ ID NO: 413053 - DNA, 564 bp, Homo sapiens
gcacaaatacaagtcctcattctttttctagaggttgtagagtattatttcattttatagatgtgccataatttatgtacttagtcatttgttaataggcattttattgtttccggttttttgctgcctcaaacaatgctttgatgtgtatatatatgtatatataaaatatcatctttgggcacaatacaggtatattcgaatttcctgttggtgaaattgctaagtccaaatatatgtgcatttttaattatgaaatgcattgccaaatggctcagcgaagagattatataaattaatcaattacacttccaccaacaacaatcaagattacctgtttcttcatactcttgccaacaccatgtttgattgaatttttttgatctttgaaatgttatagatgaaaaattgggagctctttattacttaaatttgaatttcttctactgtgagtggagaggaaacttttcatattgtgttgtttgtatttctaaccatatcctttgcccattttccaatatatagttcttctcactgtttcgtaagatattttgatatattaag

SEQ ID NO: 413054 - DNA, 700 bp, Homo sapiens
cagaaagcaaaggtgtcactacctcagccacccatgtggacagtctgtggttatttggcatcattatcattcttcacactgaatttatacgctactgataagcaatcattttcttacacttattcatacataagtacataacagtaaaaaaaaagacacactgttaacaccgtgtaaaaacaatgtgttcagtgtaactaagcggcacagcagcatcacagaatacctggatcagctgttaaacagcagcaacaacagtcaatgcaggctttcagtctctacctaccatgctgggttttgattagaaggtaggaggttgtacagtaacccccgtgaggacactgaataaacagtgcgtcacatacctgcgttatgactgtgacctgtcacgtgaggtgggatgtggaattttctacctgtggcctcatgttagcactcaaaaagtttctgatttttgaacattttggattttgtgttcccacattagagatgctcaaggtgtacttttaatattagtactcatcgtggttcaatccagggtggtggcataattggtaataaacatggtacaaaggaacttttcagaagagggtgtcacccatgttccatctagtccataacaaattgggaatcactctggaatgttttaatatagctggttttaatcattatagaccatgtagattaataattcttttgc

SEQ ID NO: 413055 - DNA, 500 bp, Homo sapiens
acacttgaagacctgtcatttaaaatgattctacaggaaaaagatgaactacaaattggggaaaaatatttgtaggacttatgtagacaaaggactaattttcttaataaaaacatttatcagtaaatttaaatgggcaaaggaaatacttggacaatcatatcatgtatgtaatattaatatttataaatcaataaaatgggctagggatataaatcagcaattcaaggggagggtaaaaagaccaactaatatatgtaaagatgcacaaattcattcatgattaaatgtgaattaacaacgttggcctctcggattcccaaaactttaaaagattaataatatccagtattggttgggattataagcagatatgatatttcactgatagagaccagcatgactgtctcaattgttaaactattgaaatgcatctgtgtcaatggtaaatagtattattgtaagtacaacactaaaattaataaattgtgtaaattcta

SEQ ID NO: 413056 - DNA, 606 bp, Homo sapiens
tcacttggccttatctgtaaactgggagtagtattgatggacacctcctagggctgttaggaagattaaataagatcacataagcaaagtgcttgttcttttgcttggctcagagtgagaaattcaaactctgagcatccctgggtaactgcagaagtatttaaattgatctccttctcttctcgtccccttataatcttcccacaagcaaccagaatgaccctcgaaaacataaagtatatgatgtcactctccaaaggcttcctattgctctgccctcctgtcctacacccatgctcctgtgctctaacccattggatgatttgtttcttgctactgccattttttctccacctggcacgctctgcccttgatccctgcatggctggctccctcctgagagaggcatccgcatagaaaagtgttccctccatcacagtctgttataccagcctgttttgttttcctcacactctgaaaatatccttttatttgttattttttatatgttatatgtgtcccaacctacccccaatgtcacctcctttccctcccttagaatgcaagccctctaaggggttcttgtcttctttttcacagctgggt

SEQ ID NO: 413057 - DNA, 383 bp, Homo sapiens
cctgtggcctaagccagaaacttgaacatcatcttcccaatctggagttccctcatctctcctactcccatctctaagaactctgccttctttccatcattgtagttattcacatctcttacctggatcacggtaatagcttctattttttttttaaactttgtttttaatttttatttgagatggcatcttactctgtcatccaggctggagtgcagtggcatgatctgggctcactgcaacctccacctcccaggctcaagcaattctcatgcctcagcctcctgagtaactgggattacaggcgcgcaccaccatacccagctaatttttttgtactttttgtagagatggggttttgccatgttggccaggctaatccc

SEQ ID NO: 413058 - DNA, 545 bp, Homo sapiens
atatatggagccattttttcctttgtgttgatatgtactgtacatgtcacttatggatataaccattctaatggctttttaggctgacctctccaaaagactgcattcaaagatagtctcagttcattttactggacaaggaaattaacatttttgacccaagaagaaatgccctttagtatttcagtttgccccctagttcagtcggtgtgtccttcctgctgtgccaggttctgtggtaggttctatacacagtgatttccaaatgtggctgccatcagagtcacttggggagcttttaagaaaacacaagcttgggccggcatcccagaaattctgattctggctattcgtagtgggaccagggatttgcattttaataagtactctaagtgattctaatgccgtctatgggatgatcaagctacaatccctcccaagattctctgtctgaaaatataggtaagtataggttatagaaaagtaaaaattacttcagtacggggtagttctgtaaaagataaattctttacttttcttagtgc

SEQ ID NO: 413059 - DNA, 577 bp, Homo sapiens
gaattttgagatttgaaaagtttattatcaccagttttataacaaaagtgtctttcatatgtgcaggaaacaaatatttttgataagcaagaaaacagtgtagcgtatatgtgccttaaagagagtttgtgaatgtggaaatcatggtataaaaggactagtgataagcactgaaatcaattagatatgcagttgtctggatagtttccaaaacttcaaaaaattaaatgtgcaataaaaatatacaaatgctgagtgtaaagtgtacaaatgctgagtctgggtaggagagtaaggttgtcaggacacccagttaagtttgaatttcatataagcaaagaataattgttttagtataagggtgtcccaaatattgcatgggacttacactaaaatttcatacatttgaaattcaaatttaactggtcatttctgtttttagttgctacatccggcaactggagagagaccataagtgccacatttctgatcttaaatagcagggactcataataacattttctttttgaatgacaatttaagaaaggccttttttttttttttttacaaacctaaa

SEQ ID NO: 413060 - DNA, 1137 bp, Homo sapiens
atggagtcttgctggagtgcagtggcacgatctctgctcactgcatcctctgcctcccaggttaagcgattctcctgcctcagcctcctgaggagctgggactacaggtgcacgccaccacaccctgctaatttttgtatttttagtagagacggggtttcaccatgttggccaggatggtcttgatctcctgaccttgtgatccacccgccttggcctcccaaagtgctgggattataggcgtgacccaccgcgcctggcctatacatcttttaattatattctatcccttttttcttttgatgttggcaaaagttaatatgcacagaatattgacctaagataagttttccatagttataagtggctactcatgaaatccaatgactaggaccctagaatgtcattttggctcctctactccttttgctcaatgtattcgtgaaagcatgactacaaaaggtgttaacttaaatacaacaacagtatctcagaagcaggactactgacgagaggaaaaatgtggtacagacttttaacctctggcttgctcccttttaatcaccaaacaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaagcatcctaa

SEQ ID NO: 413061 - DNA, 1854 bp, Homo sapiens
  misc_feature (1400)..(1400): n is a, c, g, or t
ttttctaaaaggattgctcagtaccatcatattatatcctaatcctattccattattttcaagtccttgattaactgggatcttactggggcaatgtgatttcctttctggtgcttctctataattttctccttgagctaataaatgaaactatttgattagtgagatagtaactatgtttgtggcatctgcttgttaggatattcttcactttatatttcagtttcccatccttcagagctttgaataatgcaaaaaattggtgattaaagtcttcggtggattctgtaatcagtctctctgatgagtaagaaagaagactgggactatctgtatggggaaaaattgatcttttcttaactatttcttttctttctttctttctttctttttttttttttttttagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtatgttttttgcttttaaattcctttaagatttttaatcatcctctcaaatacttccatgcaatctgaaggatagatgatactaccaaatttcattaataatgaaatgaattcctagtatttctgtcttcatgctgcttttggatgatgtaagtattttggcttggttaaaataaagggttggtatatcaacctgtgttacatccgtatgaaggaataccgtgtggtcattaactatatttagacagaataatgacctggaaagtaccatgaagtatgttaaagtgacataagtaggttgtaaatcctcttaaagaatgattgctgtagtgtaaaggtaacaataacagaaatcatatatgtttataaacatgttaataaaagtgaacatgcatcacttttagaatcagaaaataagttaaaatataatcatggttgaaaatcaatgtagttggaaagaattaagttaaaggctttgtgtaactgaaaatttgtgaaaatttaagcagcattttttttttgctgttctttcattttacaattcttgatttttagatatatctaaagtcagacatcttgtgttttatatgcatgacttatattacatttgtattcagaattagaagtaaatgaagtggacagtattttgcatgggttaagtcatgtttgatacaggatttaatatttttctcttttgaataataactgatccccttttccctgaatgtactgatcttttcagtttaagatttggccaattatgaaatatangctaaattcatattattatgattatccactaccccctattatatcatttcccacatagttgtaacagtttatctgttaacccgaaaagtttaaagactattctgcacaatagaaagcttggctgtgtccagactttcttgtgaggcagcaggaagctgtaagactttaagggccaggcgccgtggctcacgcctgtaatcccagcactttgggaggccgaggcgggcggatcacgaggttaggagatcgagaccatcctggctaacacggtgaaaccccgtctctactaaaaatacaaaaaatcagccgggcgcggtggcgggtgcctgtactcggaggcggcgggaggggggctgaggcaggagaatggcgtgaacccaggaggcggagcttgcagtgagctgagattgcgccactgcagtcaggcctgggtgaaagagcgagactccgtctc

SEQ ID NO: 413062 - DNA, 318 bp, Homo sapiens
cggatttttattgtatatgttatagaggtgagaaatccaagacattgttggctggctgattcttgcaaagagatgcataagtaaactagtcaagtacatcttaaccattttgggtgtcatttaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaagcatcctaa

SEQ ID NO: 413063 - DNA, 4980 bp, Homo sapiens
  misc_feature (38)..(38): n is a, c, g, or t
aaagcaatgacgaaggcctgcgtttaaatcggcacganggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatggcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattgggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaagcatcctaa

SEQ ID NO: 413064 - DNA, 2696 bp, Homo sapiens
tgctgggtaggaagtgcaatgttctttcctaggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaagcatcctaa

SEQ ID NO: 413065 - DNA, 4583 bp, Homo sapiens
  misc_feature (38)..(38): n is a, c, g, or t
aaagcaatgacgaaggcctgcgtttaaatcggcacganggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatggcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggtactgtagtcttttcattcctttcaccttttgtaagcacaaacatggcttttgtaaacagaattgattaaaataaatggcttgaccaagcg

SEQ ID NO: 413066 - DNA, 339 bp, Homo sapiens
tgatagctgagctttttacagaaggtgtaccattatttgatctctctcaacttttggcttatagaaatggacattttttccctgaacaagtgctaaataaaattgaagatcacagtatcagagaattggtaactatgctacaaatattcgccataaagtttttaataggatctagttcccacttttgctttaatcagatttctggaatgttgtaaatttggaatcaagcagtaaaacaccatagactaatataaacagccttttgttattactttgttagggaagaatgtactgtttttttccccttcaggcacagagctcatttgacttaaaaaaaat

SEQ ID NO: 413067 - DNA, 193 bp, Homo sapiens
  misc_feature (31)..(31): n is a, c, g, or t
tccgctcggcgacaggaagtgaggtcagacnggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctag

SEQ ID NO: 413068 - DNA, 224 bp, Homo sapiens
caattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggtatttgagtgggtcacatttgctaagggagcatgtgtt

SEQ ID NO: 413069 - DNA, 5056 bp, Homo sapiens
  misc_feature (38)..(38): n is a, c, g, or t
aaagcaatgacgaaggcctgcgtttaaatcggcacganggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatggcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtaaaaagcatcctaa

SEQ ID NO: 413070 - DNA, 5051 bp, Homo sapiens
  misc_feature (38)..(38): n is a, c, g, or t
aaagcaatgacgaaggcctgcgtttaaatcggcacganggttgctttcccgggagttcggcgtttgctggggctgcagcagctgaagtgtagtgttttcttgggactggcggtctgcacttctctcccgggttccatctccccccgcccggtggtgaggccctcgaggagggctcggacgggtgtagcgatccgcgctagaggaagacgaggcccgggaacgcatggcccccagggcaggttagggggctggaggggtcaaatcccggggtacttgtggagactctttagcgtggcttcttctctctgctgagaccccgagagctttcccagttctcctcccaggaccaccggggttcctgaagatcgggacttttctgcgcccctccaccaacagcccatctcctgtctatgaagaaagacccttcgtagaaacaacttccccgctgctgacgcgttttcccgtcccgtccccgaagtagtctactatgacctcgttgtgagcctctgaacgattttgacactttcccgaggcctagggtattatatcctaaccttactaaagaccacagaggtgcttgccattatgggaaatcagcttgctggcattgctccctcccagatcctttctgtagagagttatttttcagatattcatgactttgaatatgataaaagcctggggagtactcggttttttaaagttgctcgagccaagcaccgagaaggcctggtcgttgtgaaggtttttgcaattcaggatcccacattgcctttaaccagctataaacaagagctggaggaactgaaaatcaggcttaattctgcacagaattgtctacctttccagaaagcatcagaaaaagcatctgagaaagcagctatgctctttaggcagtatgtgcgagacaatctctatgatcgcatcagtacccgtccattcttgaataacattgagaagcgctggattgctttccagatcctgacagctgtggaccaagcacacaaatctggagttcgtcatggggacatcaagactgagaatgtgatggtcaccagttggaattgggttcttctaactgattttgccagttttaagcccacttatcttccagaagacaacccggcagatttcaattatttctttgacacatcacggaggagaacttgctatattgctcctgaacgttttgttgatggtgggatgtttgccactgagttagaatatatgagagatccttcaactccgcttgtagacttaaatagcaatcagagaacaagaggagagttgaagagagcaatggacatcttttcagcaggttgtgtgatagctgagctttttacagaaggtgtaccattatttgatctctctcaacttttggcttatagaaatggacattttttccctgaacaagtgctaaataaaattgaagatcacagtatcagagaattggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctgaaaacatagctctgctggcagaaacagctctgagattcctggaattagtacagttaaaaaatcttaatatggaaaatgaccccaataatgaagaaatagatgaggttacacatccaaatggaaattatgacacagagctccaagccttacatgaaatggtccagcagaaagttgttactttgctaagtgaccctgaaaatattgtaaaacaaaccttgatggaaaatggaataacacggctgtgtgtattctttggacgtcagaaagccaacgatgttttgttgtcccacatgattactttcctaaatgataagaatgattggcatctacgtggagcattttttgatagtatagttggtgttgctgcctatgttggctggcaaagctcctcaattctcaagcctctgctgcaacaaggtcttagtgatgctgaggaatttgtcattgtgaaagctctttatgcccttacttgtatgtgccagttaggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatgaaatctaataaagcaaaggccaatatagtggaccagagccatcttcatgatagtagtcagaaaggtgtaattgacttggcagctttaggcataactgggagacaagttgatcttgttaaaaccaaacaagaaccagatgacaaacgggccagaaaacatgtaaaacaagactcaaatgtaaatgaagaatggaaaagcatgtttgggtcactggacccaccaaacatgccacaggccctacctaaagggagtgatcaggaggtgattcagactgggaaacctcctcgttccgagtcctctgctggcatttgtgtccctttgtcaacttcttcacaggttccagaagtgacaactgtccaaaataaaaaaccagtaataccggttttaagtagtacaatcttaccatccacctatcagattcgaattacaacttgtaaaactgaacttcagcaactcatccagcaaaagcgggagcagtgcaatgctgagagaatagctaagcagatgatggaaaatgctgaatgggagagtaaaccaccaccacctggatggcgtcctaaagggctgttagttgcccatcttcatgagcataaatctgctgtgaatcgaattagagtctctgatgaacactcactttttgcaacatgttcaaatgatggcacagtgaaaatctggaacagtcaaaagatggaggggaagaccaccactaccagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcagaattctagatcagaaggaggacggttgtgttgtggatatgcatcacttcaactctggagcacagtctgttcttgcctatgccactgtgaatggctctctggttggctgggaccttaggtcttcaagcaatgcgtggactttaaagcatgatttaaagtcgggcctcatcacttcctttgctgtggacatccaccaatgctggctctgcattggtacaagcagtggtaccatggcttgttgggacatgaggttccagttgccaatttcaagtcactgtcatccttccagggctcgaatcagacgcctctcaatgcaccctctgtatcagtcctgggtgattgcagctgttcagggcaacaacgaagtgtccatgtgggacatggagactggtgacagaagatttactctctgggccagcagtgcaccaccactttctgaattacagccttctcctcatagcgtccatggtatctactgtagtcctgcagatggaaatcctatcctactaacagctggctcagatatgaaaataaggttttgggacttggcttacccagaaaggtcctatgttgttgcaggaagtactagttccccatctgtgtcctactacaggaaaataattgaaggcactgaagttgtccaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcacgcctggccccttacatcacactccaatcggtatccttggatcttgcgcagtcattttggttttctcgttccgagcctcagtcagcccactttgctgtggagtgtctctgtgtagtcgttatattggttatttgtgccctatacaaaaatgaattggtatatgtttgaagtggggattccgtgttaagattctatttgtgacctattatagaataaacacatttttatgtataaaaattctactagctacggttcgactgttaaa

SEQ ID NO: 413071 - DNA, 768 bp, Homo sapiens
cagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctggtaagagtttattgtccaaatattagccacttagatattttttaagttaatgactataatactgcttgtttttctgatttgtttgagaattgcaagtatgaactttgctctttgaactatttgtgtacattttgataatatttctagttactctgttcctgggaatcaacgtttgtgtgttctctcacttttgaaatgatcagaattatcaagtgatggaattttgtggttttcttaggaatactaca

SEQ ID NO: 413072 - DNA, 390 bp, Homo sapiens
caaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtagtgagttgagaaataacattacttaatcttttaaattttttaatacaaaagaaatacactgtacattattgttcataaaatttaaaacagtggagaag

SEQ ID NO: 413073 - DNA, 508 bp, Homo sapiens
gggctcactggcctgcttctcattcctgcctatagacctccaacctggccccaggccctctccctccccgaagacccactgggctgcttctgcaactctcccttggcaccgcatgcagctttgtgctgtcgtttcctagttcatatttttcatggttccctcatggatcaaaagcttgaggtctgagagcagcaagctacgtatggtaatatcgccggtagtgcctggctcacagctcaggaggtgggtggctgcccatttcttcaaaatgcatatggtctggaacaggagttgatggtgtgtaatcacttttttttttctttttgagacagagtttcactcttgttgcccaggctggagtgcaatggctcaatctcggctcactgcaacctccgcctcccgggttcaagcgattctcctgcctcaccctcccgagtagctgggattacaggcacctgccatcacgctcagctaatttttgtatttttagtagagacagcgtttcacc

SEQ ID NO: 413074 - DNA, 485 bp, Homo sapiens
gaatatgattgcagattacagtagaatatagagggatctctataacggattttgttctttaaagaataatgaagggacttagagatgtaagtagtcaaccaagtgaaaaaatgtttattttaaattttattttttgtataaaaattagagaattaagaaaaataacctgttgcctcactatcttatcagaattgtctgccagtctttgtacatctttgatttttataaacttgtaattatatttatgtgtggcatttacatagatgtacctatatatggataactgagtctaaaaatttctcaaataaaatcatttcataaaaaacttttctagactgctaaacacatcatgtgtttaccaatattaggctgatgttcttcagcaaaaaatttaagaaacatttttaaatagaaaaacatctcatctttttaacgtagttttcaatttcttcatgcaaaaatgcacttttatctctcattaagaa

SEQ ID NO: 413075 - DNA, 467 bp, Homo sapiens
tcactttgcctataaaatcttgatacatgactaaaatactgtacttcacaaaccaaattcggttcaattaaattgttgaatctaggtggtaggtaaagaatgctcatgcactattatttcaacttattagtaaatttgaaactttctataataaaaagtcaaaaggaaagacgggtgcagtggcacacgccaagttgcagctactcaggaggctgaggcgggaggatcacttgagcccaggagttagaatccaacctgggcaatatagcaagaccctgactctaaaaagcaaaaagaagccaggaaaggtggttcacggctgtaatcccagcactttgggagggcaaggcgggcagatcacgaggtcaggagtttgagaccagcctggccaacatggtgaaaccccgtctctactaaaaatacaaaaattagccgagtgtggtggtgcatgcctgtaatcccagcta

SEQ ID NO: 413076 - DNA, 248 bp, Homo sapiens
aaggggcttgaggaacttaagtcttactgctgctctagtttttcttttcaaagatagcaatgtataaaattttcaaaatcaagatgtgagaaatattttaaaggttttaaataaaagaaatagtcctaaaaatgatttggctctagaaaataccaaaagttaataaaaaataaaaattatctttaccactgtgatttagttaaaaagcctatgtcattcttaatgctgtaaagtctaattataaaaga

SEQ ID NO: 413077 - DNA, 203 bp, Homo sapiens
cctaaatcttaaaccttacaacagttaaataagacccctttcaaagggattaacacactgaatattatatacatacagatttatatttatgcgctatacacatatatagtctttatctgtatataaatatgtgatgataatgataaaaggataatgattacacgtaggataaacatttatcaaaaattgtactataaataata

SEQ ID NO: 413078 - DNA, 465 bp, Homo sapiens
tcctttagctgacaccttgtgtggaatttaaagaatgcagagaatcagtattaactctcggggatcctggacctagtgtaaatggagctctctacgaactcttcaggagtccctcaacttacccatcaaaatgttttacagattgcatcatcttgagatgagcagctgcttcatctttggtaagaagaatgcagttccagggggaccactccagggatttattccatctgaccatgaccagatcactgagattgtcgcaagcactgaggactgactgggacgcccagatgttctctgtcaggagaaatctgactaatacaacatggaatattgagccagcacttcttggtgacttacattaaagccctagtacatctaagattctctacaaggaaatatacatctgtcatgtcaataattcctgaataaaagtagcaaataagaatttaagctgaaataaacatc

SEQ ID NO: 413079 - DNA, 266 bp, Homo sapiens
acctgtaaccccagtctaaatagcagaaagacattgcacaaacccagagtgagggactctcaagaatgcctgaccagtactcctcaaaatgtccaggtcatcacaagcaaggacagtctgagaaacgtcacatccagaggaacctaagaatgaggactcaatgtaaaagggatcctggaacagaaaaaagacattgggaaaaactaatgaaatctgcccaaagtgtagagtttagtttagttaataacaatttttaaagaggtatt

SEQ ID NO: 413080 - DNA, 882 bp, Homo sapiens
aagcaagtgagtgttgtgcacaacagtctgacattaaatccagtactctttataataacacccgttacagaatctgacttttgtctttatggctaaagaagcagtgctgtatcccacagtagtacaaagggcaaaagatgagtgccagcccggctggaggctgacaggcttccaagaacctgaatcccctcttggactcctggcttgcttttggctacagaatcatcatctgcatctggagatttccactgggactttctggaggcagacaaatcctgccctgattctggggaccatgcctgtggagatgcacagttctaccattcaaaaatgactatctgaaaatacctcctaagaaggacaaaacttttcttcagccaagagggcacttgttaatatgattagatacatatgtaatggtgtccccctcccctcttagcccctcagtgtgtgttctctcagtcagtgtatctacatgcaggagacattaaaggatggatgtaacttcagaccttcatttccccataagtattgctttcagagaatatctaatgaagtcacatggatgaagatttctgtatcatttgtttcccagaatggctctccaacttacatttcatcatccacccacatatccacttatccattcaaccttcatgtactgactgaaaactcctcttatatagttttcctcagcagtttcctcttctggggattttctgctgttttggtaacctgttttaatgttgtattttatgtgttcctaagggcaatgcaagttgtttaaagaggcaattatctcatgtgatttatgagatttgctggacaaattccaataaaaatgtgccgccttccttaaaggaggtaatcctgacctcctcc

SEQ ID NO: 413081 - DNA, 1197 bp, Homo sapiens
atgcccagaaaatatggtaagctatgttaacaagccatattagatatcaagcattaatatggaaataaaccagcccacctgcacccaggtgaaataaacagctttattgctcacacaaagcctgtttggtggtctcttcacatggacgcgcatgaaatttggtgccgtgactcggatcgggggacctcccttgggagatcaatcccctgtcctcactgctctttgctccgtgagaaacatcactatgggcctcaggtcctcagaccgaccagcccaagaaacatctcaccaatttcaaatccggcattgggctctcaccattggccaagattccctgccccggtgaggccggaagcagttcagacacctgacttctggcaacatgtgagcctgacccaagcagatcactggtgaccagtaaatattgaagctccaagagtattttccaaaagaagagcaagggcccggctggaggctgacaggcttccaagaacctgaatcccctcttggactcctggcttgcttttggctacagaatcatcatctgcatctggagatttccactgggactttctggaggcagacaaatcctgccctgattctggggaccatgcctgtggagatgcacagttctaccattcaaaaatgactatctgaaaatacctcctaagaaggacaaaacttttcttcagccaagagggcacttgttaatatgattagatacatatgtaatggtgtccccctcccctcttagcccctcagtgtgtgttctctcagtcagtgtatctacatgcaggagacattaaaggatggatgtaacttcagaccttcatttccccataagtattgctttcagagaatatctaatgaagtcacatggatgaagatttctgtatcatttgtttcccagaatggctctccaacttacatttcatcatccacccacatatccacttatccattcaaccttcatgtactgactgaaaactcctcttatatagttttcctcagcagtttcctcttctggggattttctgctgttttggtaacctgttttaatgttgtattttatgtgttcctaagggcaatgcaagttgtttaaagaggcaattatctcatgtgatttatgagatttgctggacaaattccaataaaaatgtgccgccttccttaaaggaggtaatcctgacctcctcc

SEQ ID NO: 413082 - DNA, 851 bp, Homo sapiens
gccttgctgcaacgactctcttaacatccaccgctacacaatctgacttttgtctttatggctaaagaagcagtgctgtatcccacagtagtacaaagggcaaaagatgagtgccagcccggctggaggctgacaggcttccaagaacctgaatcccctcttggactcctggcttgcttttggctacagaatcatcatctgcatctggagatttccactgggactttctggaggcagacaaatcctgccctgattctggggaccatgcctgtggagatgcacagttctaccattcaaaaatgactatctgaaaatacctcctaagaaggacaaaacttttcttcagccaagagggcacttgttaatatgattagatacatatgtaatggtgtccccctcccctcttagcccctcagtgtgtgttctctcagtcagtgtatctacatgcaggagacattaaaggatggatgtaacttcagaccttcatttccccataagtattgctttcagagaatatctaatgaagtcacatggatgaagatttctgtatcatttgtttcccagaatggctctccaacttacatttcatcatccacccacatatccacttatccattcaaccttcatgtactgactgaaaactcctcttatatagttttcctcagcagtttcctcttctggggattttctgctgttttggtaacctgttttaatgttgtattttatgtgttcctaagggcaatgcaagttgtttaaagaggcaattatctcatgtgatttatgagatttgctggacaaattccaataaaaatgtgccgccttccttaaaggaggtaatcctgacctcctcc

SEQ ID NO: 413083 - DNA, 575 bp, Homo sapiens
gggtttggtagtcacttgatgctccttagtcatacatttagcctctccagcacccagcagcaaggcaggagctgttcaaatggagaataattggcagaagaccaaacagaaacagtcttactctaaaaccctagaggacttgtgccttcggatcctgatttattaagtgagaagtccactatcctgaagctgctatgctggagagaccatgtgaaaagatcatatagaagtagaaagatgcccaagaagccatatatgcttctttctgtagctgtttcagtctgcccacccagggatcggacatgttagagaaagagtcttaaagattatcccaaccccagccaccatgtgactgcaacctcatgaaaaccccacaccagaacagtggtatcagctcaaactttgcaagggctaggagactgagggcagctgaccagatttatgtgattgagcctaataaactggcctgagtaagcttccctggttgacaatattctgcgagtattatcacacactggatgtcaggaaattaacactgtccacaactcatggaaaggacaactgggagttctgtg

SEQ ID NO: 413084 - DNA, 740 bp, Homo sapiens
aattatcctaatggatgcccttttgtgcacacagctgtgctcagtgttataaatgggtgaagagaatttactcccttttacagatgaggaaggtgagggatggcgagaggaagtactgatgaggccatatggtgagtcagtaatagtggctggcctggcaccaagcagatgcctgtggcctcaaagtttgaggcctgtccatttactcacagtctgaaaaagggtgctgccagctcttcagacagctgtttgcaaccagggttaccccatgtgcatcagtaaaataaggagggatatttgtggatttaacacctgcctctatcactaacaagtcaaatcccctttctcaagacgtatttctcactgtccccagatctcttcctgaagtgccagtttgatcagaacatttttggccacaaaagtattttgttaatgttagtggaaagactcctatgcgccccccccccccattgcttatagaatggaggcgacattcttttcttttttctttttttttttttgagacggagtcttgctctgtcacccaggctggagtgcagtggcacgatcttggctcactgcaaactccacctcccgggttcacgccattctcctgcctcagcctcccgagtagctgggactacaggtgcccgccaccgcacccggctaattttttgtattttttagtagagatggggtttcaccgtgttagccaggatggtctcgatctcctgaccttg

SEQ ID NO: 413085 - DNA, 642 bp, Homo sapiens
atctaggccaattttaagtggggcacaaagcaagaaaagcctccacggcaagtctaggctttgatgaaaattttccttccacgtggaccttatggttgagcataccatataagattgctagttggaaaagcctcccgaggtgctgggactgcagacggagtctcgctcactcagtgctcagtgttgcccaggctggagtgcagtggggtgatctcggctcgctacaacctccacctcccagccgcctgcctcggcctcccaaagtgccgagattgcagcctctgcccggccgccaccctgtctgagaggtgaggagcgtctctgcctggctgcccatcgtctgggatgtgaggagcccctctgcccagccgcccagtctgggaagtgaggagcctctctgcccggccgcccatcgtctgggatgtggggagcgcctctgcccggctgcgaccccgtctgggaactgaggagcctctctgcccggctgccaccctgtctgggaggtgaggagcgtctctgcccggccgccccatctgagagagctcctgccttgctgctgggtgctggagaggctaaatgtatgactaaggagcatcaagtgactaccaaacccaaactccccatcaagcactgggtacgaac

SEQ ID NO: 413086 - DNA, 890 bp, Homo sapiens
tttttgagtctggctttttccacttggtgtggtggtttggggattcattcattcctatttcagcattccactgtatagtccagaggtgagcaaggcaaggctggtgggtggctctgttatccatctcctgtgtccaagcgactgctccagttgtcaccatgtttccagtcaccaggtgagagagactctggctgcagagacagggctgagtgtccgtgtcgtccaggtgtggttccaaaaccagagagcgaagatgaagaagctggccaggcgacagcagcagcagcagcaagatcagcagaacacccagaggctgagctctgattggtgttctcatacatgctgacttgacttttacaacacccattcctggaggcgagtggagaagttgttattatccctatgtcacagatgagcaaacaaaggctctgcaagattgaatgtggccctagatcgctcagacaaacggtggtgggagtgctgggatggaaggaatcatgaacccctacacggctctgcccaccccacagcagctcctggccatcgagcagagtgtctacagctcagatcccttccgacagggtctcaccccaccccagatgcctggagaccacatgcacccttatggtgccgagccccttttccatgacctggatagcgacgacacctccctcagtaacctgggtgattgtttcctagcaacctcagaagctgggcctctgcagtccagagtgggaaaccccattgaccatctgtactccatgcagaattcttacttcacatcttgagtcttcccctagagttctgtgactaggctcccatatggaacaaccatattctttgaggggtcactggctttaggacagggaggccagggaagaggtgggttg

SEQ ID NO: 413087 - DNA, 817 bp, Homo sapiens
ctctgtttggcctttgtacgcagctacgagaaggcgctctgaaagtgcagcgaccgcatcttgctggctcatgaattaggaaagaaaggttttcagggaagcggtagacaagttccttcagctcaacacgaagtcactggcccggcctggcacccagagcttccagaacacttcctccttctgagaagatctactcccacaggtagggcccttaacacagtactacctatgaggacactcagcactgactgctcacggaacctggtgcccaccaggactatttgcgaaagaagggaaatgacagggtggacacgctctgctttagcaagcccatgactcattataaatacaccccactgtcacaaagaaacaagtatgtttatttcttgagccatttaaagcacaaaaactctcttcttctaactctgtcactgaatcttttgaaataaccacctctgcaggaggcatagaggctgttacagtgaaagctgagtgacatctgaatattattcaggaaacctgtgacatacccttccaagaaaagctgcttacagatgtaaaaatcacataggaggaataagcacatatcaccgaataaagatgtgactgacagaaggcttgggaggtagagaccgtccctttttatgtaggacaataacttattgactgaccagcactgctagaccaccagagcctccaagtcagggctgggcactcccatcacttggcaaatgaccatgcgcatactcaaagttcagaccaagtgttatctctgctaagccttctgctgtccctgccttgccctagacaagatgac

SEQ ID NO: 413088 - DNA, 555 bp, Homo sapiens
caggtttcgccagcctgttgtgagaggacatgttaggtgaggccattacacctaaccgtagcttactgcagcctcaacctcctgggctcaagcagtcctcccacctcagcctcccaagtagctaggactacaggcatgcaccatcacacccagctaatttttgtattttttgtagagacagtgttgggtggggtgttttgtcatgttgcccagactggtctcaaactcctgagcttaggcattcctcctgccttggccttacaaagtggtaggattacaggtgtgaactactccacctggcctgttttttttccttctttttgagtcagtgtctcactctgtcactcaggctagagtgtagtggtatgatcatagctcactgtaacctcgacctcctgggctcaagcaatcctcccgtctcagcttcccaagtagctgggactacaggcaaacgccacctcacttgcctagttaaaaaattttttgtagagatgggatctcgttctgtcgcttgggctggtctcgaactcctgggctcaagtgatcctcctgcct

SEQ ID NO: 413089 - DNA, 387 bp, Homo sapiens
tcagatgagcaacaaagaagtttcattgggtttggaaaaataagaattctgctcttagtgtagtgagttttagaaccccctggagatatagaataaatatttaaatatgtggaggtcaggagatagatttaattcagagacacctatctggtcatcattcatgtattcaatcaatatatatcgagtacctactgtatgtcagtcagtgttcgaggcacaaaattactctcagggagattacattctagtggggcttttaaaagcaatagaaggaaataaattcactcaagaagaatatgcattctaagagaaggaaacgtgagacttaacactgtggactttaagagactgctaaatggcagagtcaaatcactccaaccaagctta

SEQ ID NO: 413090 - DNA, 330 bp, Homo sapiens
tgccgaacagctgtctgccatggaatcattctctgagaacactcttgatcttgagcctgtaataaattttcacaagaatctcctctgggaaggaatccatggtactttaccattgtagaccaattgctagagaaatatgtgatacaacaatgtctcatacataatgttataaataactgttatttgaaaaggtcacagtaaatatagtactatataagaaatccgtctcctgctatgggtaacactgaaaataaatctgaagcctttcacttttagggctttcttatatgtctttaccacaacaatatttttgataaagtaataaatcga

SEQ ID NO: 413091 - DNA, 424 bp, Homo sapiens
ttcatagaaaatagactgtactaggcataacttgttatatctaatttaccataaaaaaatttttttgattattcatgtgtgatcctattcaacagaaaacttgggagagttaagtaaggtagattgaggctatagttgccagtctaaactcctttaggtcatattgattagatcactcaattgcatgtaaatgttgattcattaattggtatttcttatgtctgtcttttcttcccaactacattccaggactttgtaacagagatccttttcttattttcccctatattcactgtgactcttagtgcagcattctgcattatagtagatagtaaatatttgttgattgaaatcattgggagaaaggatagcaagcaataaagaaaacagagcaaaattactctaaagtacatgtattatcatg

SEQ ID NO: 413092 - DNA, 604 bp, Homo sapiens
atccccacatgtctagggagggacctggttggaggtgactggaacatgtgtgtggtttcccccatgctgtcctcatgatagtgagtgagttctcatgagatctggttgtttgataagtgtctagcacttcccccttctttttctctctctcttgccaccatgtaagacatgccttgcttccccttcttccatgattgtaagtttcctgagacctcctcagccacgtggaatgtgaatcagttaaatcccttttgtttataaattacccagtcttggatagttctttatagcagtgtgaaaatgaattaatacacccagcatccactccaataagttaggaagaaaatggccaagtaaacttcaaggaggcagaagaaaagaaataaatattacaacagacaataatgaagtagaaagcaaacatcaaagctaaaatttggccatttgaaaatactaacataattgataaacttctcataagattaattttttaaaaaataaagaatacacagaagactaatgtttgaaataaaaatagagacaccaccacagacctttcagacattaaaaagatgacaaaatgattttaaaagaagacaaagaa

SEQ ID NO: 413093 - DNA, 380 bp, Homo sapiens
gatttaaagtatacaggaggatgtgtgtatgttatatgcaaatatgacatcattttatataagggccttgagcatcctgggattttggtatccacaggggttttggaagcagtcagtccctcacagatactgagggaggactatatttttaaagcaaataccaaagagttattgaaggaagaagtaggtgacttatggtgcagccctgaggcatttgacagttattctttatcctgcctgcacttaggagctatgctgcttcccagtccctctctccctttcttcccactcctatagtttctcctttcctttccataaagatagtctttcttagcccttccttttttctcttctttctcttcctctggccacagcatctc

SEQ ID NO: 413094 - DNA, 395 bp, Homo sapiens
gagtgcagtggtatgatcatagctcactgcagcctcaacctcctgggctcaagtgatactcctcctcagcctctcaagtagctaggactacaggcatgtaccactgtgtctggctaacttttgtttgttttctgtaaagacaaggtctcactatgttgcccaggctggactcaaactcctgagctcaagggatcctcccaccttgaccccccaaagtgctaggtttaccagtgtgaaccactgtgcctggcccttcttttctttagtacctcctcatgtgtgcttgctcttgaaataatgtttattatattgctagtttcctcattaacaagttaaataaatttttggtacatgttttatatttgtatgcaggcttcccatgtgtctgtaatagt

SEQ ID NO: 413095 - DNA, 459 bp, Homo sapiens
actctatcctttacagaaaacagaagaaaggaaaagttactctgactcttagagggtgactctaacagttgtgagtaggagtaagaatcccataacactaacagaaggaggccctgaactctcttccgtatatcttaatatggacacttcagcatttgaatctgcggaggaacctggtccatttgggtgggatacacattcagtcatttattcagttatcatttaagtctctacctaataaagaatctaaaccaataaataagaattcatgtcttattacttgtctgtactgttggctgagcttaggagctgttgattaaaaaaaaatgttgtattggccagacgtggtggctcacacctgtaatcccagcactttgggaggccgaggtgggcagatcacaagatcaggagatcgagactatcctggctaacacggtgaaatcccgtctctactaaaaa

SEQ ID NO: 413096 - DNA, 469 bp, Homo sapiens
ctaacaggagactgtgagctttgtgagggctgggaccttctctaccttctccaccgctgtatccccaccatcaggaatagatctgacacttgacagttgctcattatgtactttttgaatgactgagtgaatgaacattgtatgctttcaggactagtcaagtgtcagcttactcacaccgcttcctcggtaatactttctgtcatctggcttgttgaagctttgttttttttttttttttaaatagttttaacatgttaaaaaataatttgcttcccttcctacttccttatcagcttgtatttaggagatgatatcaggaaaattaaagaagtataaggatggggttgatgttcctggtcaaatcataatcattatattatcaatttgtttgccttgagagaagatgtcaaatttttcggccaggtgcagttgctcacacctgtaattccagctctttggaaggctg

SEQ ID NO: 413097 - DNA, 418 bp, Homo sapiens
gatattctacattataaaattagaagttagccgggggtggtggagcatgcctgtagttccaactgctccggagtccgaggcaggaagattgtttgagcccaggagttaagaggctgcagtgagctatgatgatgccactacactccagctggtgcaacagagtgagatcttgtctcaaaacaaacagacaaacaaaaaaccccaaaaccaaagacataatcactggtccttgcttacaactaaaatgtggtgctggcagagtttacaaatgggaaactagaatttagatctaggggtcacctttcaaagacccaccactttaaatcctaggagtaaaaaaatctagtatgaaatataatgaactttgatatctaacttacatagtaagaaacaaggttctgtactaattaaaactaca

SEQ ID NO: 413098 - DNA, 396 bp, Homo sapiens
gtgttcttgtgctggctggaaaggtactggttgagtatgttcaagccacaaatacgtgaaacacattccctggggaagtcaaggtaagctggtacacagggagatggggaaatgaaggagaaccaagtcagacagtgaggcgtgacacaatgacctgtggagttcatgcttttctgtcttatgaagaatattggtgcctaaatggaagacaaagcaatcttagagggcgcttgaactagaagcacagtgaccaggtagggcctgaactaaggcagccatagtgggactcctcatgtgacagaaacaaagagatatcaaagctaaagtgcagcagcccagggaaactgcagacaacaggtcttagggggccgggtgcggtggctcacgcctgtaatc

SEQ ID NO: 413099 - DNA, 509 bp, Homo sapiens
tggagagttgctgtgcagctgatataatgtttcagctatgcaagatgagtaagtcctggatatgggctggacaacgttgtgcctacagtgaacaatacagtattgtgcactgaacagtttgtttagagggtagttcttatgttaaatgtccttatcacaataaaacataaataataaaattaaatgttggttgagatggcaatgagagaatgatattcaaagttaattgtgggaagactagtgtcagagcacattaggagtgtgtagtttcgagactgcggctctgggtagagggcagctgaggttgctggcaagtattctggcaaatgactcagcttggccaggcttacacacagagtgaccgggattggcacagaggcctggggtggtctcgcagagacagaggcctggaataggtcagaggcactgaatcaagggcccaaggggtgccaaccagcactactagcaaggtgcgtgcagaggactctgttgattagggccccaggttg

SEQ ID NO: 413100 - DNA, 266 bp, Homo sapiens
agaggggactgaggcccttaggggctaaaattctgcaagctccactcactagaccagggatgctggtcaggggctgggttgaccatggggaaagggctcctttttctaatttgtacaaaggtacaatataggctggtggtggccctgggtgtctgagctttagaattttaattttgttaggtctggaagaactgaccaacccatcagtattgatgtaaatggagtatagaaattaactttcctcattttaatgcaagtctctttat

SEQ ID NO: 413101 - DNA, 490 bp, Homo sapiens
caactctgaccccagacacaaaacccttccctaggtaccccaccccatcttgacatctcccctatatggggtcactctcaatgcaggattttcctcccaatagggacaccacctgttccctctggacctgggactcccaattcagcagccccagctagggatgtgtcaaaaggacccaccgtggagggaccccgagttttgggaaaccctgagaagccagacttgggaaatctctttgttgccaggctctgctgctcccccagccccttctcagctcccagacttcctctttgtttctttgttggggatttgttgaggagaggaggctggtgcagggttagcccagactcctaactcgccctcccggccaacaatagggggcagcttttgcttttggtcccctggcagcagagctgggtgacttctcgttagctgacctcccctgggtctgcccatgctgccagggcggcctgacctgcttctgagcttc

SEQ ID NO: 413102 - DNA, 168 bp, Homo sapiens
ggagcccttcctttgtgtgtccagggagaggacatacaaggaacacacggccttccctctcatagcattgaacagattttgcccagtcactctgtgcaccccgaagtagactgtcagtgtcctgatggcacagacctgagcaccattacacttccagagctcccacag

SEQ ID NO: 413103 - DNA, 214 bp, Homo sapiens
acccttcgcatcccttggtcactccatcctccccatcagtcttcaaggagactctattatccgttttgccaatgggactctaagaaattgagtgacctggtgtggctcccacacctggtgagagagcagagagtcagcctcacgtgcctgactcccgggacagtgctctcagacgaaggctgctttgggaaatctgaggcatctaaggcccaga

SEQ ID NO: 413104 - DNA, 215 bp, Homo sapiens
caggtgattccgaccgcggtagtagtgctgggactacaggcgtgcccaccgcagcccacctcacaacacactttcaaaacatcacgaaggagaggccaggagcaagaataaaatcttggagtcatttctctgtttagcagtaaatgcaggcacctgctttacactaagatctgtcaaagctttgggttttttttgagacagagtgtgctctgtcg

SEQ ID NO: 413105 - DNA, 160 bp, Homo sapiens
cgtctcaggaaaaaaaagtaaatctatccaagaacctagcaattcctttcccaggtatatacccacagaaataagcactgaggttctccaaaagcacgtacaagatgttcactacagctttcttcataatagtcaaaacctggaaacagctgggcgtggt

SEQ ID NO: 413106 - DNA, 200 bp, Homo sapiens
atttataacctcctctgtccacggattaaactgatgcttctattatgtagcgggggtgcaaacaattgaactaacatgcagttttactcagaaatataacagctatgaaaacatttctttataaggtaagtagttatcaaataatgtttatgcattatcaggatttttggtaaagtattcattaaaatagtatatacttg

SEQ ID NO: 413107 - DNA, 457 bp, Homo sapiens
aaatgaggggcagggatagggtttcatgggcttcggggaaactccttttttctggatttttctagaatgtaactatttagtcagtgcttagaatctggtcaggcagtcaacaaatattcactgagcacctactgtacatagcagtgaatgcacagtccttgcccttgtggaatttacggtccaaggagattatcaggtagataatcctgggcaaactgggttctcatccatggattctttccaaattctctacatcttcagggctaggggagtgctggcaaatggtaggtgttcaattttttatgtacagaggattccctaagcataagtctgtgctttctaagaactgaggctatgcaatctccgtgtttttcaagtcaccatagtgaggactcaatgaatgcttgatcctagtggtgactggggagctcctaggagcctcctccatctggtgttc

SEQ ID NO: 413108 - DNA, 308 bp, Homo sapiens
ttgcactggtgcctggtcggtcggtcggtcggttggaaccatgccccagttttcccacagacccggggctgaagggttccagtccctgtgctacgcagggatgagacacagactcttgactctctgcaagcagcagcaggggtggggtccactctaagaacttgaacactggcccttgctggcgggagggaatgcttggtacagtccccgaatccctcttgtaacaggtgtagagaaagcctagataactaactagactgaagcagctgctggtgggctggcccctccaagctcaggtggacacagcg

SEQ ID NO: 413109 - DNA, 349 bp, Homo sapiens
gctgtggccagagactgatttggcctgcctgctgtcctgctttgaaggtgaggcattccctctgcaaccctgaatcagcctccccaagcagcaaagagcagggcccctgtggaggagtcatgctgcccatggaggcagcctagctgggccaactagaaaaacccgtgttcttcccatctcatgttactcatcttcatccccaagaagggaagaggctccgaatgcagcgaatctgtccagtctttctccttgcggccaccaccctgtctgtgctgcctcctctctggcctccctgtgcccgctccggcctacactgtccaatctccacccagcaggccagggagctttt

SEQ ID NO: 413110 - DNA, 272 bp, Homo sapiens
  misc_feature (206)..(207): n is a, c, g, or t
  misc_feature (243)..(243): n is a, c, g, or t
acaggtcacgccacccatcttcttgtcaccgacgcttcctcagtatccacaggtcacgccacctctcttcttgtcaccgacgcttcctcagtatccacaggtcacgccaccgctcttcatgtcaccgatgcttcctcattatccacaggggacacaaatagcacatctgggaaatgcagacatgatccagccgggactgattcctnngcagcctaacctggacttcgtgatttcccaggcctngtcccagtccaccttctccacgtccacca

SEQ ID NO: 413111 - DNA, 174 bp, Homo sapiens
gagcccgggaggttgagggtgcagtgaggtgagcagagatgacccaactgcatcccagcatgagcaacaaagtgagaaattgtcttaaaaaaatttatgtcactttatatttccaaagaaaaatggttgttttctatgttgaagctttaatttgaggaaaaaatacctttgcac

SEQ ID NO: 413112 - DNA, 220 bp, Homo sapiens
aagcaagcactgtgctaagcactatcagtttaggttttttcttttgatgaaaaatcttgcaatgaaatgcccaaatcttaagtcaacattcattgagttttgacaaatgaataacctttagtttagtccaatgtatcaatcttttaaatggttattgctttctggccctgtcttaaaatttttgcttagcccctgagtcatgaagatattctcctgttct

SEQ ID NO: 413113 - DNA, 475 bp, Homo sapiens
attgaacagagaggccaaaaacctgttcttggtgtgattcagtaaggtaagtaagtggttcatcctctttgcctttcaaagcaagagtaaaaaggtcagcactgagttacatgctttaaagcctgtcacccttttgtacttgttagaattaaacgtgggcattttgcaatacataagcgcttcttgaatggcataaactctcaaaggatgttcgatgccaacctgctttgtttaggagtaattatgttactcagaaaatcctaatggaacaaatggatgtggagttgggtagcaaaatattttccccagatcctttgctttgcttcagtaccttgtgaataaagaaaatcaaaggcatttcctaattatttgtaaatggtagtaattgacattttgaatattactcatacaaacataaatgacagcaaattaaattcaaacaaatttttatagtttttatataacattggctgaa

SEQ ID NO: 413114 - DNA, 458 bp, Homo sapiens
gctgctgaggccacacaagagcaaaaccttacatgctttccaactcctccagtggggttttgacaatcatcctcagagcttttagtcgcatggtgcctccatgtgcctcatcttttgcttgactctgttgaaaagaaaaaacaacagtgcctgcccttacatttctctaaaaggccagtgcaggagaggaatctacatgtttcatcgaaaggtctcactcctgcaaagaagagtttgagccttcattcaactttgtagaggttatgaaaaggctaccgagacattggcatgggtgccggattccagattccaacaagggaatgagtataggcttcaggtggaaggttattagaagaagtaaatttcaggccttgcctcctgccaagctcagagataggggcctggcaacttcatgatgcaatttgtgcaagagttgcttgctggactgaattctggtc

SEQ ID NO: 413115 - DNA, 322 bp, Homo sapiens
cacttattggacattcaattaatcgatcttgtggctaagccacccttgacagccttcttttgaaagtttcaaagcacttcaaactggctttatctgccttactatctcactcaatttcatagttactctgtatttttagaagaatctatcccagtctgacaaatcaatagatactgaattaatctcctccagcgaaaatttgcaaggcctggttttgtaagtggatacggtttggcattttttttttttttttagcaataaaagaggcaaaaaaaatacaaacccaaacatttgatgagaaatatctacaacatttaatgtt

SEQ ID NO: 413116 - DNA, 536 bp, Homo sapiens
tggccatgtgggaagaaagggactcctggccactcatacgttttctctataaaaagggggctgagcagaggacgcacaggctgaacaccaaggctctggtgagctatgccattcccagggtctagtctcagtctggcactcacagatactgatctttgggagcccggggtgggctagttctctagccagggagtaggaagggacctcttgccttgacaggtgcccccatttatcatccaatgggtcaccacctcctggtgagccagttctcccttgtacagctcttcacactgtgaagttctttctcatctcaggtgagatcagtaccctagggtcttccatccactgggcgggtcctttcctcaatgcctgatagagtgccccactcctccttctcctggatgcctaagaaggggccaagtgcagacccttcctcaaagggaactggtgctaaatagccaagaaaagaaccctaaccagcttggctcttctcagcaatctggcttgcttctctgcttcaggtgcaaatgtcacat

SEQ ID NO: 413117 - DNA, 224 bp, Homo sapiens
aatctattacagctcctcaaacatagaagatatttaatacatttattttttcatgaaagctttcaggtcctggaaaacgctaggatggatatctattaaaaaataaattgcaggctgggtgtggtggctcatgctggtaatcccagcactttgggaggccgaggcaggtgaatcacaaggtcaggagatcgagaccattctgtctctactaaaaatacaaaaca

SEQ ID NO: 413118 - DNA, 266 bp, Homo sapiens
gagacggggtttcaccatgttagccaggatggtgtcgatctcctgacctcatgatccaccctcccaaagtgctgggattacaggcatgagccactgcgcccggcatctcagagactttgatcatgacccaaaggataaaattctggaagagaagggatggaaaggatgaggataaagctggaaaatgtgggggctgaataatttagagccttagagaagaatttattctgagtaaactgaaaagctattgaaagctgtaggcagtg

SEQ ID NO: 413119 - DNA, 295 bp, Homo sapiens
acagtgagccaagatcttgccactgcactctagcctgggcaacagagcaagactctgtctcaaaacaacaataaaataaagagatatcccacttgcggcaaccttccccagtatatcttactgaatgcagccctggaagtgacctaaaacaagttagcttccctgccaggtatgagtcccctcagctttgaggctgggcagcctgttttcctctcatcttacacgctccagctacagggatttccccttctttcactggtagagttttcaaatccccccgcctcctgaatgctat

SEQ ID NO: 413120 - DNA, 331 bp, Homo sapiens
ccagaggaatgatgagttagaaatacagttgagtcaccccggtagcttctcatcacatttggaacaaaatctcaagtccttaccatggccgtcaggacgtgaggtgatctggctcctgcttgcaagctctgggcttgttttcaaccttccttctccccatctgctctcctgcagagacgcaggctcctctgctgttccctgaatgggctcagccccttcccgcctctgtgcctcggcatgtgctgcgccttcaggccgcggggctctcccctaaggtacctgtattccccctatctacttcctgtggtcccaagcagccctcctaggacaa

SEQ ID NO: 413121 - DNA, 456 bp, Homo sapiens
gggctgtgccaggggcatggtgcaggagaggcagtggtccagcttacaccttcaatcactccagttgctgagtggagaagagcttggagaaggaatatgggaagagggaggtcaggtgtttggagtctgtggcagagtccaaatgagagatgatgacgacggcctagacaagggaggtggctgcagggatgggaagaggggagtgaattcaggtgctggacagtcatgccgctccttgtaccgtgtctaaaggcacgatgggaggagccgcaccaccattctgattagaatgacggcagatgtgcccactctaaggtgaaatggtgaacctactctttaagaagcaggtcttgtaataaaagagttttgctacgactcatgctctgtgttgtattgttgaaatatgtcaagcaatagccactgttccagtggcaaaaagaatcattaccctgactc

SEQ ID NO: 413122 - DNA, 424 bp, Homo sapiens
ctgcctgccttggcctcccaaaatgctgggattacaggcatgagccaccatgtctggccaactatggaaaattttaaacatacataaaagtagagtagtatatgaatcattgtgagctcattaacaaaagataatttcagttcactttaaaaattgacgtgtgaaagtttggactcatacattttgttttggtctaaagtttccttggcaaatattcacatggttccattgactctggctcctttttaagataggatgcttttttatttttttaagagaaaaattattgctctgacaagctaatcaaagatatttaattttggaatttggaggaaaggcataaacctagtttattacaaaaatacctctttttagttttcctagccttaaagtaggagacaacctccctccctttacacaggtt

SEQ ID NO: 413123 - DNA, 424 bp, Homo sapiens
ccccaccaccttagtgcatacaacatcatctttagtataaatgggtgcaaaaatctccatttaaaaagatgaatctcttaaaaatgcaacagcatagtacatttgaaaaaaatgaaataaggtcactttcggccaggcgtggtggctcacgcctgtaatcccagcactttgggaggccgaggcgggtggatctcggggtcaggaaatccgagaccatcctggctaacgtggtgaaacaccgtctctactaaaaatacaaaaaaaaagttagccgggcatcatggcgggcatctgtagtcccagctacttgggaggctgaggcaggagaatggcgtgaacccgggaggcagagacggaggttgcagtgagctgagatcgtgccactgcactccagcctgggtgactgagcaagactccgtctcag

SEQ ID NO: 413124 - DNA, 441 bp, Homo sapiens
aaggtgggtgctgggaagacaaggaagccatgcaggagagctcttttcccattcctttctctctgtctcttgctccaggcctcatttttctaggatggccaaaaatttcttgaggttaaagtctctctttgcacatactactgcaaagaaagccatctaaaatcaatttagatgcgacagttaaaacaatgtctcgtcctgcaattccttctatgaaatcagatctaaagtgttagtcattttatattgaagctctagtttgttctgttttgtcgatgtaatagggtgaccagttgtactagtttgcctggaactgcgggttttcccaggacatgagattttcagtattaaaacctggaaaaccttatatgctggccttatatagactatactcatacgtccctcttctctctctcagttttacctccaaagtgatgtgat

SEQ ID NO: 413125 - DNA, 480 bp, Homo sapiens
ctgggagaaaattatggaaaactgtggatctggaagggcttcttatctgatatattcaagaaactaatggtcccaagtggacaaaaacacaaaaaccaatacacatgctaaaattgcccaaaagactggcataggcatttctgaaaaaacctgcaacagactcgcgggtaatagaagttcctccacatcagtaatcatcccctaaatgcaaatcccaaccacactcagatactgccaaactccccagagaacgagtatgaccaggaacagcaataaaaccttttgaagataagggcagtgtagatttgcagacagagaaactctcacacactattggtaggaatgcaaatttgtatacccactgggagagacagcaggaggtttctgaaacaacaatacaactaccagttcccgtagccatcccaacattgggtataccagcaaagccaaggaaccttgtaacttaaggagatatttgcc

SEQ ID NO: 413126 - DNA, 494 bp, Homo sapiens
tagtagagacagagtttcaccatgttggccaggctggtctcgaactcctgacctcaggtgatccgcccacctcggcctcccagagtgctgggattacaggcatgagccaccgagcccggcctctgagactgacttctgggactagtttcttgttttgtttttaaacccaagtccctgtgtgataacagcaaaaacctttatcagttaattaatcagtctgtctctctctcacacacagacacatacacacagattctgatgcgtcttcccgcgttaggctcactctcagcctgtctcctgggcatctccaccagccaagatgttgtaaaattttccttcctgtggttcgatgtgtgaaaacaataggtattcttttccttctctaagtatggagttatatcgtaatactcaacaggctctttcaacctacatggaaattctttccctgccccataaagattctggtgccttccccgagtttgggagtggagcat

SEQ ID NO: 413127 - DNA, 481 bp, Homo sapiens
gtgctggggttaccgtcccacagcaaacttaatacattttcaaaacttagcttgagctgggcacagtggcatatgcctttagtcctagctacctggtaggctgaagtaggaggatcagttgagcccaggactccacgacaagatcctgactcaaacccaaaccaaaaccaaacaaaacttaacttggacgtcacctcctttgtgaagtttttctttccttccttaggtaattaattgttccctacaatgttctgttcattaaagttttgtttacatgtttttattttctactaacatttgaggtgtgctttgggaagacagggactattttattcatctttgtcctcatgacatatactaggtaaccagtatttgctacatgaaaccaataatgttctataggaccgagcctcagtaattcatattgtgctaacatgttttgtgtttcagactttgaagacaaatgtagattaactcactc

SEQ ID NO: 413128 - DNA, 326 bp, Homo sapiens
ggggtcacattactcccctgcctaagctagcataataacgtactcactagaacagattactactctttagaacagactacaacgccttgcagtttctgatctcttccttcctccctaaatcttatctttattctctttaaccagtctcaaggcttttgcaccagctgctcagcacctgtcaaaagcaaagagcgtgaccaagaactgtacctgcagccaagctagcattcacttataaatacaggaaaataatcccagcactttgggaggccgaggcaggcggatcatgaggtcaggagatcgagaccatcctggctaacatggtg

SEQ ID NO: 413129 - DNA, 472 bp, Homo sapiens
aaattttcccagctctgatcatcgcctccttcattagatcctatggccagttttctgtgtcagggtccccgtgaacaccactggacactcccacaatggcatgggaccccctccgggtgataaagccaaaacggcagtgtctggcaaagtgaggaaaggtgctgctgcttttactgctgttacaggccgttggagtagccctgctgtagtgctacaagtttctcaaaaattttagtcaaatggctctgtagcattttatttattttatttatgccctgctgtttgccaactctcaaactctatgttgtcttatattttaatttctttttcctttttttttttttttttttttttttttggagacaggttctcactctgtcacccaggctggagtacagcggtatgatcatggctcactgcagcctcgacctccaaggctcaagctatcctcccacctcagcctcccatgtag

SEQ ID NO: 413130 - DNA, 445 bp, Homo sapiens
ttccaatgtctacctttgagtggaaaaccaggatgaaagcagtcctaaagcgtgaactttcagcaatttgcaaagtgaactgggggccagggaggccactgggatagtctcttctgctcccaccctcaatgttgccccatattttctgggaggggtgggaggtgacttgcccttatacccttctgataatagaattgagtcaagaatttccctgagtttagcatagaacctaagaggccatggtaatgggtaacagatctctgtgatttagagttatacagccaccccagccagcactggcatcctggaacctgtgcaatgaaaataaacgggaacctgggtaacatcagcaggtgaaataattttaccgagacatctttaacgataaataaatgcaagtatgaattatccagacttctggaatgccacagggaggagctcggca

SEQ ID NO: 413131 - DNA, 386 bp, Homo sapiens
tgggcaggggtcacctcagtggcagccttcatagaaagctgctatagtcacaggtgcaggtaaactcaacttgtcccaagacatgatcagtgcacacagtgctatgataaaccacgatgatggtagaaactggtattttacttgctatgcttactgaacatgtacgtgtactcagagtttctacaatagcgtattagcatgcctctgaagaacactactaatccagaagccctaaaagaaaatgtattaaatttgactacataaaagtacaaaaaaaggccaggcacggtggctcatgcctgtaatcccagcactttgggaagctgaggcaggcaaatcacaaggtcaggagttcaagaccagtctggccaacatggtgaaacccc

SEQ ID NO: 413132 - DNA, 396 bp, Homo sapiens
gtagcttgggtcacagcaagaagggaaaaagaaaggacgattatccattctatggatcattcctaattccccacaaaaatcaaaagctgactgaatttaattttggaatacgcctggagggagaatttggtactacgctgactgcagatgattggataatatgacccaaatcaaatcaaccaaattctcactccaggaaaaccagaattgagactaccatcatagttcaatctggactgatctctaaaaggaaagaaatcaaaaccaaggtgtgggtggccatccttcacctacaacaaaggttaagaagccaatccgcagagaaataatgaatcaaggccagaagcagtggctcacgcctgtaatcccagcactttgggaggctgaggcaggcag

SEQ ID NO: 413133 - DNA, 255 bp, Homo sapiens
tcaggggactctaaagtacaatggctaagagtaccagagtcagactacttgtgctgaattctggctccaacactgtctccctgggttccatactactcttagcctcagtttttacatccataaaaagggatcaataaaagaatgtctgactggggcaacatagtgagaccccatctctataaaaaattttaaaaattagccaggccagacatggtgcatgcctgtagtcccagctcctcaggaggctggggtggg

SEQ ID NO: 413134 - DNA, 339 bp, Homo sapiens
tttacccagtctcaggcatttctttatagcagtgtgaaaacagactaatacaaacatattacttagttatcttaaagtccattccaaaatctccagtatttggatctcatattggttcatttctgctttttagttttgttttttcttgattctggtcgtttgtctttttctccatgtacctagtatttttttctttttttgaatggtggccattgtttattttttaaaaacctgtagattctaggctatcatgtatcttcctccagggaggattttattttgcttctgccaggtgctaaggtaagaactgattattttaatctgactgagatggatttt

SEQ ID NO: 413135 - DNA, 258 bp, Homo sapiens
cttttctgctctcagggatgttggagtgtacagggagagaataaagaacagacaaaactgaaagcatatattcaggctgtctgcaaatatgtacatttaaaagctattcattagctacttttgcaaaaatatagaagacaaacaataaatcagcagtgctgttacccaaattgaatccgatatataaaggcatttttaaataaaggatcttttgtttaatatagttgttacgttgttacagatcgatggtactttctc

SEQ ID NO: 413136 - DNA, 484 bp, Homo sapiens
  misc_feature (68)..(68): n is a, c, g, or t
atcaggaaaggctatgaccgatggagagagatgtttactgcatgaatttatacatctcttgagaagtnttctagtatgtatgcatataagtgtcgcagtagttcatgatggcatgttctatttctgtggggtcagtggtaacattccctttgtcatttctaattgtgtttctttcaatcatcctctgtattagtctgctagcagactttcttattaatattttcaagaaacctacccggaattcatagatcttttgaatttctttttttcatgtctcggtttctttcagttcagctcagattttcagttatttcttgtcttcctctagctttggggtttttcttacttcaactatactttttgcaggacctatatcttatgaattttgcagtctatatgtataacatgtgacaaagattcttaggactagcaccaaatgtggaatagaatatccaccaccactgaaaatgcaagatggaaaatg

SEQ ID NO: 413137 - DNA, 357 bp, Homo sapiens
tgatgcagcattcccgggtagaataatacagatctcaataaatatagcagaaatttgtttaaacaaaacaaaacaaaataaacaccatctctccacccaagatgaaaagtctttccaaattaaaaaaaaagaaaaagaaaaacagaaaacaagcaaaaccctccaaatttttcataattgttagtgcctatatagaatataatacacaaaaccatttagcaggtgcatgcaagaggcgaaaggccaggggatgcagaggcttctggtcggccctgaagtgtggggcccaacatgccctggggtctgcagacgaactcggaccaggagctctagtctgccgctgcctcagcgtggggg

SEQ ID NO: 413138 - DNA, 148 bp, Homo sapiens
ggactgggcaaattatcactggacaagtctgtggacccagtggatcacttaatcctcatatgggccaatattttagttatcatctggcacctcccacacccctactctttacagggtgcaatagtggtgcttgggtccctgaatacca

SEQ ID NO: 413139 - DNA, 176 bp, Homo sapiens
tattcctcatctgcaaatttaaagagtaactgttgctctgtttggcccaagaagattcaaagtgggagcctttgagcttggaaactgcaacatgcaattaaaaatataagacatgatgagtggaagcagagtcctttgcccttgaatggagcccaaacccttgaagggagcccaaa

SEQ ID NO: 413140 - DNA, 564 bp, Homo sapiens
agggcttgccctcatggaacttacatctggggcacgggagactgcgggggagtgttgcaacttcaagtgtcatggccaggaaaggcctccctgagctggtggcatttggcaaagccttgagtttggagaggagccagtcagttagacatttggtggaagaatgcacgaagcagcagaaagagcaaaggtgaattctccaaggtcagaaagtcctggacaaggtcaattacaggaagtgagggaacatggagttgagttcttggcaggccacggaaaaggctgaacgaacccttactctgtagaggaaacagtctcagaaggcccctaccccttgttaaacaggggtacccattctctcacacccactacccacagaaatccagcctcacttagaatcctggaattacataagtttctggttggaagggatttacataaatcccatagctcttcccattctgggtctgtgatcttgaatgaagctattaaaaaaaaaaaggggtgtgcggttctcgaggtgcggccaatcttcgaaggcaggtctgtgatcatccgcagactcgg

SEQ ID NO: 413141 - DNA, 496 bp, Homo sapiens
cttctgtcctcaaacactcccagccccttcctgcctcagagtctttgtacttgctgtcctctctgcctagaacaaagaatttattccagctactttgaatgccttagtccttatcagttaggctgcaggtcaaatttcaactggaaattttgaagtttgcttccctgcccaccctatttagaatagtccccactcccagctctctcaaatcaccctggactttttgtgttttcttacccttcaaagtacttaccatcactatcagggcacagactctggagctagactgcttgagttcaaactccagctcagccacttactgactctgtaattttggcaagatttcttaacttccctggtggaagtttccacatttgaaatatgagtttaacaacaggttaatgcatgtaaaatgcttagaataagtgcctgacaaataggaagtacttaagtgttaactcttagtattactgtcagaaataaactatctccccta

SEQ ID NO: 413142 - DNA, 240 bp, Homo sapiens
acaggagaacactgatgcttgctggcaggctgggaaatagaggtgccttgaagaatccatggggagcttatactggaagtctgttttgggagtaaaaaaggatgaggagtgtaaagttaaagaaaaggactgaaggccattagatgttcttcagcgagcatactcagctgttaagtcaaaaatactgctgagctgaggccgggcacggtggctcacacttgtaatcccagcactttggga

SEQ ID NO: 413143 - DNA, 515 bp, Homo sapiens
tggagctggttttctcctctgggagggatgtggagcctggggagccaggaaggcatggactgaatatacacccagctgggcagtggggaagggaggattccgtggggagctagccctgaacacagcaagcatttggtaaatggtgcctgttagctgtttttatccgtattctaaggtggacgagcggcgcaggagagaactggtaggattaatggagtggtttcattattcagatttaagtgcatgcagccagaagtcttcaactgaagaattgaaactctctgctcttttttgggggtcatggtggcagtgtgaggggctggttcatgagtgaggagaaaaggtagtggcaggcagaatggtacattttatattcatattgtgcacattattcacacctgacatgggccagaaatcctctcctaagagagacacttggaaagtaaacagtttgttaatcatttcaacccgtggactttggttgcagggtgcattttgatcaagggttacaaaca

SEQ ID NO: 413144 - DNA, 456 bp, Homo sapiens
acctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagag

SEQ ID NO: 413145 - DNA, 189 bp, Homo sapiens
tagcgacagcacgacttctcagccccggaggtggtcctgcctgtgggtggggacgggggctggagagactaaacggaaaagggaacgctgaggttggcatttgcctggatctgggaacatcgtcgagttggaaaacaaattgttaggtactcaataaacgcttaggatttaatacacgatttacacaac

SEQ ID NO: 413146 - DNA, 328 bp, Homo sapiens
ggcccacagagtctaaaatatttggtatctgaccctttacagacaaagtgtgtcaagccctgctctctatgtacttggagctacgaatgagaggaggaataataacaatgactctgtaattcctagacacagggaggaaggaacaattgtgaaaataaatggtatttctttttattgcctctttacaaaaaggcatctagaatcaatacatttgatttgggacacctgatacagactttcaaccagtggttaagttatgggtttagcagaaaaccactgacttcagctgtcattctgtcccaggtgcacctgatccatcatctttgtc

SEQ ID NO: 413147 - DNA, 282 bp, Homo sapiens
ctagatccctggggaattgccacactgactcccacaatggttgtttctttatattttctctgttttgggtgtttgctttaatataaggatttgttgataaccgtgagttatatgaaatgatatcactaactgtgatagttgataaagtaacttttgacagaaagttaaatttattcaaagtatgggttgaaagttcttaaaagtgctcacattctttatatttcaaaactgggctaatgagcaggccccaggataaagtgaggggtgggggccattgattaa

SEQ ID NO: 413148 - DNA, 454 bp, Homo sapiens
agggctactgtgaagacttttatgtgcacaaactggaaaacttagaggagatagataaattccgcaaaatatacagcactcctagattaaatcaggaagaaatggaaactctgaacagaccaataacaagcagcaagattgaaatggtaattaaaaaaaaattgccaacaaagaaagtccaggcccagactgattcacggctgaattctatcagacattcaaagaagaattggtaccaatcctattgacactattccacaagatagagaaagaagaaatcctccctaaatcactctatgaagccagtatcaccctcataccaaaaccaggaaaggctgtaacaaaagaagaaaactacagaccaatatccctgatgaatatagatgcaaaaatccttaacaaaatactagctaactgaatccaacaccatatcaaaaagataatccaccatgac

SEQ ID NO: 413149 - DNA, 345 bp, Homo sapiens
tattataattgttttggggcaccataaactgtgcccatataaaatggcaaacttaattaatcagttaacacataattgtgtgttctgattactccactgaccagctgctccccatctctttttctctcctccgaggccttccgattccaagacacaacaatattaaagttaggccaattaataccctacaatgatctttaagtgttcaagtaaaaggaagagtcccacatctctcactttaaatcaaaagctagaaatgatgaaacttagtgaggaaggcatgtcaaaagctgagctaagctgaaagctaggcctgttgcaccagttagccaagttgtgaatgca

SEQ ID NO: 413150 - DNA, 158 bp, Homo sapiens
catcctccctgtccccatgaggggacactgaacagtggaggacccatgcccaagcgagccaggttctggtccagtcactttcccattcagattctctccacgtaaatctgccagcctcagcctggctggaagctcttgttccccacaataacacgctg

SEQ ID NO: 413151 - DNA, 155 bp, Homo sapiens
atgataaggggaaggtgcaaaatttggaaaaaggagttcagcccctgcacgtaccccacagtacgaggagagtttcctccagggagaactgaggctgtcagaggcctgcagagcatttctaccttcaacggaggaccaggagaagcgcccatcat

SEQ ID NO: 413152 - DNA, 272 bp, Homo sapiens
ccatgttggccaggctggtcttcgaaatcctgaactcaggtgatccacccaccttggcttcccaaagtactgggattacaaatgtgagccaccacactcagcctatttcctcttagcttttgatgagacacagtgtagctttccagtcataggtcttccattatttctttgaatattttttcttaccttttctgtattctctgttataaaggcagcaggactttgtgtgctgcgtttctggcacagatattacctacatcagagattcccaa

SEQ ID NO: 413153 - DNA, 524 bp, Homo sapiens
tcactgttggatcttacatggccttcagttagatggaggagaagaggcaaacagttgaataaaggtcagtaaaatgtaaagtgacacaaagtgcagaccttctatgtggccttaagcctgaggaaaaatgcttctcttgatctggagttccaaacttctcaggtactgaacatgctttgagagctttcctcacatttctggaacagatgctggtctggaaaactctttgacacctgtttcgtaatattctaagttacgttctgggccgtgctttaaccctggatccaccaacatggatagtttttgggtggcatatccagtctcctttctcagagaaggatccacagcatccagcagggtggactctgaaaccatgttttctgtctcatggccttgcctttgctctaggtgatgtgcacagtatcagcagacccctggccaaagtgagagacctggggcttgggagttagcgataactgggtcttgtaatgactgggtctccgtaatgacccagagagaagatt

SEQ ID NO: 413154 - DNA, 325 bp, Homo sapiens
ctgtttcctttgaaataagctattacattagaacaaaatttttaagttgtttacataataaggaagtatcttttgccttctaacatttcataagtttaatacaataagatataaaacaaaaaaaaggtatacttggaaaaacaacaaagatactattagaaacagtaggtgtgtgctatacatctaaaacacaatctctgacaatcacgtggaaaattatgtgagtaagagttctgtggctgggctggtcgctcaggcctgtaatcccagcaactcgggaagctgaggcaggaaaattgcttaaacccaggaggcggaggttgca

SEQ ID NO: 413155 - DNA, 588 bp, Homo sapiens
atggtaaacaccgcaatctggatggagttggagatcattattctaagtgaagtaactcagaaatggaaaaccaaacattgtatgttctcagtcataagtgtgagctaagctatgagtatgcaaaggcataagaatcatacaatggactttagggactccagggaaaggctgggaggggagtgagggataaaagaatacaaattgggtacagtgtatgctgctcaagtgacaggtgcaccaacatcttagaaatcaccactagataatttattcatgtaaccaaacaccacctgctccccaaaaccctatggaaataaaaaataataaatgaaacagtacctagaatatggtgggtgctcaatgaatattggttggatgaattaaaaaaatttccaactatgaccaatataattggttgcttttatggtataaatatagagtccttaaaagggcccattatatggtaagacctggtttttgaagagttctctcccaatattgattattttaccactaatagtttgagtcctacttgtcacccaggttcttgtctgtaaagcccaggatttcataagattgcggtgttag

SEQ ID NO: 413156 - DNA, 362 bp, Homo sapiens
tcgcttatcacgcaatctttgctgaagataagcagttaacgagagacacaaatcttgcctcgggcccggcacggtggctccagagttcaacctcaaccatcatgatgcactctccaactagttccaagactgttttgctttgatcatctcaagagaaacggacctttgccctctgaattcctagacaggtaagtcaattcctgcttgattagcaatgctatcaccatgactcccgcactctttgctgaagataagcagtgaacgagagacacaaatcttgcctcgggcccggcacggtggctcacgcttgtaatcccagcactctgggaggccgaggcaggcggaccatgaggtcaggagac

SEQ ID NO: 413157 - DNA, 236 bp, Homo sapiens
gatctagacgatcccttaacaccgcaatctcatatgacattttgttattgaagataaaacagtccctgattttgttgtcatctacataatcaagaataaccgaatataaaatgtgtgcttggctgggctcagtggctcacacctgtaatcccaacactttggctgaggcaggaggatggcttgagcccaggagtttgagaccagcctgagcaacacagtgagaccccatctctatg

SEQ ID NO: 413158 - DNA, 116 bp, Homo sapiens
tgctgggattataggcgtgagccactgcaccagtccatgtttctaattcttggttaacaatgaaatttggggcagttactttccagattgctactgaagatgtcaccccaataaag

SEQ ID NO: 413159 - DNA, 545 bp, Homo sapiens
agggagagagggaaggagacagagaggaaggaagaaagaaaagaataattttggactacatagcaattttgccgctattcatatttaatatccatgtgccgctatacattctgttaactatttccaaaaatttttccaggttaatatggtgcgctcttcttttacaatgttttatcacttcttgagggataacatttttccttctctactaactcttacacaggaagaaggacacatcatagagactggataagcccagattccaaagaaagatgagaagaaacatggcaaggactaccagaaagatcagagcagtctacaatttcaagaattcctgcccagggccctgaggtggctttggttttacgtgatgacgtagagcagtcacctcccacccaccacaaggagactttatgctggctacatgcagagacgtcaggagctcagggatctctgctggactgcctgccagaaaccatgcacaaggagcaaaagtcactctcctctgactgtgcttccctatcagtcagggaggttacccctgc

SEQ ID NO: 413160 - DNA, 206 bp, Homo sapiens
atgctgccgaaactcacctttatcatatttttgaaggatatttgtctttcacaatcaaatggtgaaatgagagcacaaagaccatgtcctatttatctttgtagtcccaacactaaacaaagttcctggcacacatttggtgcgcaataaatggctgctgaatgaatgggcagtaggtgcttgatgtgcacttactgaatgatcac

SEQ ID NO: 413161 - DNA, 95 bp, Homo sapiens
tccacaaactccctgtcagagaccgctggagggtgctcggggaggattagttctccagcacatcactcttccttaggcacacagctagtgagtca

SEQ ID NO: 413162 - DNA, 376 bp, Homo sapiens
cattctgggcaacacagtaacaccgcaatctctacaaataaaaaaattggccaggcatggtgacacacacctgtggtcccagcttctcaggaggctgaggtgggaggatcatttgagtccaagaagtcaaggctgcagtgagccgtgacggcaccactgcactcagcctagataacagagggaaatcttgtctcaaaaaaaaggactttggtaatgttctcttctactacttctactaccgaagccagcttttttggttgcatgcagccaatatttattagcacctattatgtgcaagaagttaccgcagaattttccaggtaaatgagctagcaaatgcaagggccctaaagtatacccaagattgcggtgtttg

SEQ ID NO: 413163 - DNA, 277 bp, Homo sapiens
aagatcatgccactgcattctagcctgggtgacagagggagactctgtctcaaaaaaaaagttcctggcatgtgataagaacacgacacatattattattattggtgctgttcattttttaatctgtttttgagggcaaagttatatgtaatgaccttggtggaaatttgagattaattttctcaaagatgagttggtcactttaataacatttactcaaaaagtaatgactgacatgttcatacgtctttcaatttgaaagagattacagggtttt

SEQ ID NO: 413164 - DNA, 503 bp, Homo sapiens
ctcttctgcctatctttcaaatgttggtgattttcaggttccatcctaggttctcttctcactatatatacaatagtccccccttatccacaaagacgcattccaagatccccagtggatgcctgcaacctcggatagtactgaaccctatgcaccttctttttcctacacgtacgtacctatgataaagcttagttcagaaattaggcacagtaagagattaataacaacaataactgataataaaatagaacagttataacaatatactgtaataaaagttatgtgaatatttatctctcaaaatacattatggtattgtacaatgagtaactgaaaccacaggacatgaaaccgcacatgagcggcgactactctaaactctttaagtgatctcaaccactttcctgaacatcagacctttgtatctaagtcccttacaaggaaggaccctgaaatgtaatgttccccaccccccaaaacccagtcctcttcccacgttc

SEQ ID NO: 413165 - DNA, 315 bp, Homo sapiens
tctttattaccttttaatttttaacaggacttttacttctttaatttctttctattacattgacattttgaagactctgggagtgttgtcttatatcttatgctctggatataattatttatatttcctttacattttcttctgttgtccgaatatttttttatgaatataagtaagtatataggttgtattagatttagctaaacattggcaagaacactttacatgatgtatgaacttcacagagcattggaccaggggacccacgctgtgaagacatcccccattaaagaaactaactttaattaaggtgat

SEQ ID NO: 413166 - DNA, 724 bp, Homo sapiens
ctcgacacacccatgcctattctcacactcacacacctatacacacacatgcacactcaacacacccatgcctattctctcacacacatgcacacatgacacacacacccatgcctattctcacacacacctatacacacatgcacacactcgacacacacccatgcttattctcacacacacacccctatacacacacatgcacatactcaacacacacacccatgcctattcgctcacacacctatacacacacatgcacatgacacacacacccatgcctattctcacacactcacacacctatacacacacatgcacatactcgacacacagccatgcctattctctcacacacacgctcacacacctatacacacatgcacacactcaacacacgtgctcatccagtcacacgtttacacatatgcacacattcggatacacgcacacccggtaccttcacacacacatgcacacactcaatacacacatacccatgcacattcacacatacacatggacacactcagatacacacacctatataccttcacacacacatgtgcacactcgatatacacatgcttatgcatatttgtgcacgcacactcatatacacacacacccagtaccttcacacacatgcacacaatacacacatactcgtgcacatccacacacttgatacacaatttgcacacacatccatgcacacacttga

SEQ ID NO: 413167 - DNA, 137 bp, Homo sapiens
gcacaagtatttgaagaattattttttttgctcttttttttttgaattgcagaaatttatgaaaattagagacattgtttaatcttcttgtgccatgagactccatcaggccatctacaaagaccactgggaggcta

SEQ ID NO: 413168 - DNA, 446 bp, Homo sapiens
tgggctgggctgggggtgggtagtaagtcagtttagaaaggactgaagtgccaagcacatttttttttctattgtaccggtttttatgtagtttatcctcagtggatcctggacgtttatatttgtatacccattttaagacaacagcctatcccttagaaccatatttaaaaaataggtttacataagcaaactttacagcatgaaagacttttgtcttatcaaatacactttcattgggagcctttcttcctctaattagaagtctgaacttgttaacatattttatgtttttattagccagcaggttcattctgtaataaaggcatttcttttccagaattatactttcaaaactttcttgcttaaaagatttttctcattaaatatttatgcttatttttaaaacccaagagtgtaataagaaagcctcactttatgagtct

SEQ ID NO: 413169 - DNA, 393 bp, Homo sapiens
tactgtaacagattacatagactggagtacttaaataacagaaatacatttctcacggttctggaggctgtgaagtccaagatcaagatgtgggcagacctggtgtctggtgagggctggcttcctggcttgcagatggctgtttcctcattgcatcctcatatggtgaagagagaaaaacatcatctctgttgtgtctcttttgagaaggccactaatcttattcacaaagctccatcctcatgacctgattcttcccaaagaatcttccctcacctccaaataccattacattgggaatttaggctccaacctatgaatttagggggatacaaacactcagtccctagaagtcatcttgttgctgctttagatattacaacttttaagtta

SEQ ID NO: 413170 - DNA, 445 bp, Homo sapiens
caccattgcctccttcatcatgcatgatactaaggaaagagaggaccctggaacctaactgagttcctatggctgcaagcctggagagaatacgattcgagaggtgaataatccacaggcaaataactacaagctatttcttttctttaatgtctagaatccctcaagttgctggaaatgcaattaggttcctagataggagaggacaaattatgttctttggttccgttcaaaatttggaacattatttatgttccagggttgctatttcaccaacagaagtgatcataagagaaaaaggcccacccctacattcctgcacttttccattctttagatgggtcctgacaggtgactgtctctgaagtgggtgcctgctgagagctcagaagagctgccagcacaggaagtaccttgagcttgacagaagtgtgcacattgggcc

SEQ ID NO: 413171 - DNA, 377 bp, Homo sapiens
ggaagcagagacccatatggtcttcagatacctcaagggcttccacagggataggactattttagatgtgggcccagtgggggcccaggaccagggaaggaagccagctagctctcagttcagcattggaggaatctctttaatagcggcactgtctccaaggagtgtgggtatttagtgacagaagtaaatgcctcttcacctcccacaccctcctaccccgacgaccttgaaatgctggagcagagaccagtgcgtgggtggggtgtgtgagacctgtcacagaggcagcccagagtcagacagtccatctggaccagtggtttcaaatttgggcctctcaatgctctcttgaaatgaagccttttacagaagac

SEQ ID NO: 413172 - DNA, 560 bp, Homo sapiens
  misc_feature (49)..(50): n is a, c, g, or t
cgtgactctgaggatctttgcggagtgcatggctggatccaaaaccacnnaatcagcctcctggagtttcctcctcctctctgcgggtggaaaccccaagtcagctcaagcgcctggcattccgtggaaaatgtgtgtctttattgtccatggcaaggcaccaacagccgttctgaacaggatgctgactcacatctgccgagacacactgactgcacaaagaaaatggatttcatttgtgtttgatgaaggtctcgggagagtgggggttgacttggaaaacaaaggaaaactgtccagatcctctccttacctagattatggggaagaccacgacttgacttgactaagattactgagcataccagtatcaaagctgagaagaaatcatctttactaaaagaaggtcagaggcatgccacaaagagaggacaatgccacagagttatgggtgtgtacacgtggacgtagttcatttattataataatagtaaccttttgccgggcgcggtggctcacgcctataatcccagcactttgggaggccaaggtgggcggac

SEQ ID NO: 413173 - DNA, 493 bp, Homo sapiens
ctctacactgcgactgatggtgatcaaacaaaatagctctatctctctctctgcgtgaccagtagtacgctgtcggaaatttttatgtctgcagacacagccgttctgaacaggatgctgactcacatctgccgagacacactgactgcacaaagaaaatggatttcatttgtgtttgatgaaggtctcgggagagtgggggttgacttggaaaacaaaggaaaactgtccagatcctctccttacctagattatggggaagaccacgacttgacttgactaagattactgagcataccagtatcaaagctgagaagaaatcatctttactaaaagaaggtcagaggcatgccacaaagagaggacaatgccacagagttatgggtgtgtacacgtggacgtagttcatttattataataatagtaaccttttgccgggcgcggtggctcacgcctataatcccagcactttgggaggccaaggtgggcggac

SEQ ID NO: 413174 - DNA, 143 bp, Homo sapiens
ctatattaaatgcaatgactgaagaagttatagcttaagaaaggtggaaatcaaagaaacgatggaatctcaggaaactctcaaagaataatttgttttttttagacagagttttgctcttattgcccaggctggagtgcaat

SEQ ID NO: 413175 - DNA, 361 bp, Homo sapiens
ttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccc

SEQ ID NO: 413176 - DNA, 306 bp, Homo sapiens
gctcatgcctgtaatcccagcactgtgggaggattgcttgaggccaggagttagagatcagctttggcaacatagcaagaccctatctctacaaaaaaaattttaaaatcagccaggtgtggtagtgtgtgcctatagtcccagttattaggttggtgcagaagtaatcacggttcttgccattagaagtaatgccaaaaaccacaattacttttataccaaccaaatactttggaggctaaggtgggagaatggcttgagcccaggagttcaagtttgaaccatgattgcaccactgcactccgg

SEQ ID NO: 413177 - DNA, 379 bp, Homo sapiens
ggtactagttgataaaattgcctggattaatgaagagggtaataaaaaggtgctaaaactcaaaaatatatgatcactaattagctggtgtgctagaaattttgattaggtatttacttggtttttgagtaacacaagtgtttttatctacctctgccagttagccatggaatctttgtcctagcctactgtaggtacttaagaattaatcacctatataagaaaaggcagtttattttggtttgctggtcctttgtaagaaagagagggctgaagtagacctttgctacctttccctttccggtcactaatggctccagcttggaccttacagttggtgttttctttggcactgaagttgagccagcaggtatcaggg

SEQ ID NO: 413178 - DNA, 1263 bp, Homo sapiens
caatgccaaccaaggtcactgaaaacagacctcacctagaggttgaaatagtaccagtgccatctgagctccaggaaaaaaggccccttcacagcttctaaaacacatagttgctgccaaaataccataagctgttttctaaaagccactggttttacccaaaatggtagtatccttcaaccaatctgacttccctgagttttgaaagtctctaagctaaggacagaaccgttgaaaagctgcttctaatttaattctccctaaattgagaaacctccacatctattaaaatcaggatctactttaaaaaaaaaaaaaaaaaaaaaaaaaaaaaaaaaaagaaaaaaaacgaaaacaacaaaaagacaaaaaaaacaaagagaagaacacaccagagagaggaagaaaccacagagagaaagcaaaagcagagagaccgatgaatcaagcatgaagcagccacaaaataagagaagagacagaagagaacaacagacacaaagcacacaagcgagaagcaaaagagagaaaacagacagccgaaagaagagagaagaaagagggaaaaagagaaagcagagaagaagaaaacaaggagcgcaggaaaaagagaaaaaggaaaagaagaaaagagacagcaagcaaaagagaaaagaagagagagaaggaagaaagaaaagagaacaaaaagaagaagaagacaaagacaccaaagaagaagcagaacaacaagacaaaaggaaagaacagagaagcgaagcgagagaaagaaaagcaaacagagatagaacaaaagagaacagaaagagaaaaagaaggcaaagagaaacaaagagaagaaagaaaaacaaagaacagaagaggaaaaatatgaagacagaactagacctgaaaaacgaaagtagaaccaggaagacaggaggagcggaacgaagcgaaagagaggagaagagaacgagagagaagcacgacgagagacaggacggaaagaagaaagaaacaaggcagaacagagagccagagaaaaaaaagacgaagaagaaaggaggaaaaagaagacaacgaaggaagaaaaaaaagagaggaagagacagagaaacgagagaaaggaagagagaggaaaagagaaaaaagaagaaaacgagaagagagagcaagagaacaagaggaaaaggaagagcacaaagagaaacgagagaaaaaagagaacaaacgcgaagaacgaaagaagaaaggagggaaagacagaaaagaacaaaaaaa

SEQ ID NO: 413179 - DNA, 381 bp, Homo sapiens
caatgccaaccaaggtcactgaaaacagacctcacctagaggttgaaatagtaccagtgccatctgagctccaggaaaaaaggccccttcacagcttctaaaacacatagttgctgccaaaataccataagctgttttctaaaagccactggttttacccaaaatggtagtatccttcaaccaatctgacttccctgagttttgaaagtctctaagctaaggacagaaccgttgaaaagctgcttctaatttaattctccctaaattgagaaacctccacatctattaaaatcaggatctactttaactactgattgattttcttttcgtgtatgtgacagcgtattgaggattactccgtgggctgggccggtcttagcg

SEQ ID NO: 413180 - DNA, 531 bp, Homo sapiens
ctgtctcacagcccttgccctccctgggtcagcatgccaccacccaggcccctctgtaattcctgtttgagcctcccaccctctgggagttgcttctttgactcccacttcctgctcttgtgcctcacttcctggaccccacagagcacaccctctgtggaccctccccaaccctcacctccctcttcacccaactcagagtcaggttctgtccttgtaatctctcccctcgaaccctgacccactccctctccctcctactcacctggactctcccatctaactaaatccagtgcttcctctgctgtgggcctgcccgcagcatcaccacctgtcctccctcagtggacagccgtaccatgcctcctcctccaccaagagaagtgcagccttgtggcagctctgcatcgcctggatgctgaccggctgcctctcttgcccctcaccctcccaaggccatcactgcagcagttccttcccctccggcacgcagcttctcttttccttctcgccagagcagtcccatcagcg

SEQ ID NO: 413181 - DNA, 394 bp, Homo sapiens
ttacatgacaatatgacaatgaatgggtaaaataatattttcccttatggagtttacattctaatgtgtaaatgccagaagcctatgacaaacaaacaataagcatgtaaacacatataattccatactttcattaatctgtggggaaaataaatcacattaaggaaatagagagtgactggtagaaagaattttggttattttagatagactggtgaagacaattctccttggggaggcaaatctgggcagaatactgatgtgatgcaaaatgaagattttggacgtaaaaagacttgggaataggcaggagtaataaacagagaatataaagatcttgatatggcaaaatgttttatgcatgtgagagaaagagtggttggagataatgtta

SEQ ID NO: 413182 - DNA, 212 bp, Homo sapiens
ggccgcaggggagctggtgtgagggttctgtgtctggatgagtctgtgtgggtcctagtggtgagcctgttccccactttcacaagaggcaaccacaggggaaacaggataaagggtccaaagggcctctctgcattatcactgcatatatatctacaaatatctcaaaaagtctaaccaaaaaactgaatgttcccactcacccccaggtc

SEQ ID NO: 413183 - DNA, 322 bp, Homo sapiens
gccaggacctgggagcagctgcctcacggtgggctgagtggagatggcacccgatcagcaggacccaaagtttagtccccctgtctccagacggccccttagaatcccagtctccaaaacccttccaaagcttcctcctgccacgaggggcgagaccttgggccgggcacctgctgaccacagagcctcacccaccagtgacattatcaacctgtgtgcagctgccagagccctcagtgccacaggacgactctaggcccttgtagaggcacttcctctccctccccccggaaggctttcgccacacggacagcccaggtgg

SEQ ID NO: 413184 - DNA, 372 bp, Homo sapiens
aataggatactgcatcttacctggcatttattacccttgatggaggcggaaataagaactgttgtatttggatcttcctagagcagttggtgaactgatggtgcactagactaaaaaattcacagaaacatctggaaaggtaagatcaagtactataaagtgtaggacagtttctggcaaagtagcctccttcttggtaaggttgagtctttgggaacttggggacgaatccctgcagaagtccaatctgagcaccttgctattccttctcatgagtaagcccaccacattctccttctcctactttcaggataaacttcatcatggtattttggtgcacatcttcattgggtagtatccaactatattttc

SEQ ID NO: 413185 - DNA, 314 bp, Homo sapiens
agtgcaatggcgccatctcggctccctgcagactccgcctcccaggttcaagcgattctcctgcgtcagcctcctgggtagctgggactacaggtgcgtgccaccatgcccggctaattttttgtatttttagtagagatggggtttcaccttattagccaggatggcctcgatctcctgacctcgtgatccgcctgccttggcctccaaagtgctgggattacaggcgtgagctactgcacccggcctgtatttgctatttttaagctagaagtctttgtagtaacaatttatgaatatataacccagagcag

SEQ ID NO: 413186 - DNA, 199 bp, Homo sapiens
ttccagttgtgtcttctcaagcctgtttggaatatgaaagaggtctgtgactgagctgctgtgcctctcaacaactgctgtcagctacacaaagacccagctaaagctccaaaatgaatattgtgtgtgtgtgtgtgtgtgtgtgtgtgtgtgtagttattgtgttggtcccttcggccgtgttgtggctattaggaaa

SEQ ID NO: 413187 - DNA, 161 bp, Homo sapiens
cggttccaggggcacgtaatttcaatacgcatttacaaacttcagtattcatgggagtttttttctatctcataaaatatttggaacatccatgcaggaatatttttagttttccttctttccctcaagttgcatgtgtagaatgggagttctaatgttcc

SEQ ID NO: 413188 - DNA, 538 bp, Homo sapiens
ttgagacagagtctcgctgtgtcgcccaggctggagtgcagtggcacgatctcggctcacggcaagctccgcctcccgggttcatgccagcctctgagtagctgggactacaggtgcccgccaccacgcccagctaattttttgtattttagtagagacggggtttcaactgtattgcccaggctggtctcgaactcctgagctcaggtaatccgtccgcctcggcctcccaaagtgctaggattacaggtgtaaggcactgtgcccagcctttcttcttgatatttaggagttctttaacagtatgcaatgcaaatatcttctctgtattatacctataaacaaagaggaaaatcgtatttctttcttggaaactcttttttagctttaaaaatccaatcagtcccagtaaaaatgtaaaaattacccctactgacttactttgggggaaaccctctataggtataaagatatttaagtacctgagcaattgaaagttattttcctaattaataacttggaaagaaaaaaattactc

SEQ ID NO: 413189 - DNA, 416 bp, Homo sapiens
ttctttcctttttttttaagctacccaggtgattcctatgtgcaatggatgatgagagcaagcggttcaatgtccatcttcctgggagcctccaaacccctcaagtgtaaaggctttggctcagttgttcatggctgttttcctaattcccaccctagagcattaaagatatctgttgaatgaatacattaaaaacaaacaaactgtgctttgtttcattgctgcttcactgtgttcttgattcaacagccaggtaaaaggaaaagcttcccacaggccacaccccaagcctctggaaggatgacacttctctaagcaaatgaagcagctggttgcagcccagcgttcaaaaccaagctgatgacaggggctgtgtatgaatgcggatgtgggtttgtgcctttcaacttgtaaga

SEQ ID NO: 413190 - DNA, 388 bp, Homo sapiens
cacaattgggatacccttttagagaaaacaaccattgcttttatcgttttctcagtttatatgttgactagtgctaagtaacctaagtaacgtgtggcttcctggtcacttttggtgtcttgatgcctcttacatttgatattactaatgtaatagggtaaaaatagtattgtagaaatgcagcattcacatttgttttgggctggagtgcctagaggcagcttcaggtgcacatgtcttactgagttagtactctcttggaacagagtgtcaggaaaccattgcaggagaatgtggtctcagctggtgtctagcttcagcctgattgcttggggagaaatggatgccaattgcacagcagagtttattccactttgggacaaagaga

SEQ ID NO: 413191 - DNA, 430 bp, Homo sapiens
gctggtcttgagcacctaagctcaagtgatcctcctgcctcagcctcctaaagcactgggattacaggtgacttatcttgactgaatcacgggtgcccaaggcttactagtctcccaagctataaatctgtcttctgaggcagaacgtgtgcggcaggggactgtggctgctgcctcgtggagtgggggcgaggctgcagtgagataggaggtgatggctatcgtactttttcccttctgcaacaaactaggtagcatcctgtgggagcacagttgcaggagataagatgcccagccctggggcttcaggctggctgggcagatggacaggagagaagcgaagagatttcccatgtctgatggtggtgaatgctacagacatcagcagtgctggggctaggtgttttagcctggaggtcgaagcctctcg

SEQ ID NO: 413192 - DNA, 220 bp, Homo sapiens
accctcacccatgaaaacatgctggcttataccttccttgcaggcagggccgtgcctcctgtcattgatcccctcattcatcagatgcttattggggctgcttattgggcctgctccttgccagccttgcaatgggatatggcagtgattacttcttgtacccccagtgcctggcaccaaataagtgtttgaagaactttagctgctgctgtaatcagtt

SEQ ID NO: 413193 - DNA, 179 bp, Homo sapiens
tacgtgtaggttctgtctgagagaacccagcctaatacatcatgcagcatattatcagaataaaatttgataatgtatgtacaatgctgaacacagcatctggtatttaaaaacatattcagcatcgagttactgtaactgctgtcattgatgcctcttcttctaaaatgagatgccat

SEQ ID NO: 413194 - DNA, 348 bp, Homo sapiens
ttttataaacatcacttcttcctgcacagggctttatgaatgtgcaacttcctctgaataacaacaggacttttataacggaactttcttcatccataactatctacttttctaaagatgttacctgcgagggctgatgtccttttgcttttgacgggcatcctttccgtcaggtcggcgtttgaccacacctccttcgcctgtggaggcacaattgagtaattgaagttacatatcacatctgggcttttcaacctcagcactcctgacacttgcgctggatgattccgtgtggtggggaatgtcacgagcattacaggacagcagcatcactggcctctatccacc

SEQ ID NO: 413195 - DNA, 392 bp, Homo sapiens
accaagtcatttggattgccagtactttgctatagagtacacaaatgtgcctcattgcaataacactagaagttgtttactactgtagtttactaagaactaaccacatagatgatcatgcatttcaggaaaatatgatagaaataggaaagattctaacccaggtcttaattattcacatacggaagaatggcctgtatatcttcattatatgtgtaggggaaaatagtgcctatctttcaagatcattggaaggttagagatccttttgttaaatcatgttagtttaaaaaatgcatttatttaaaaaagtatttctgtagtattaataactgattttttgacatctttgtatatgcttaacgtggctttttaagagtcacagtttacca

SEQ ID NO: 413196 - DNA, 403 bp, Homo sapiens
cctggcatttaggtacgattacagtagtactttgcttgtctgcaaggaatacattccaaaacccctagtggttgcttgaaaccatggatggtacagaaacctatatacactatgttttttcctatatatacatacctatgataaagtttaatttataaattaggcacagtaagagattaataataataaaattgaacaattataacaatatactgttaacaatttcacagatataagacttgttcttactgtagatcttagcaacctcagcatacaattttttcccttctatattaagttgagaactttcaccttttcacttgaaggaagtggcttctccttggcatatccgaattgccagcctcactactcttgcactttggggtcattattaagtaaaata

SEQ ID NO: 413197 - DNA, 269 bp, Homo sapiens
atccaaaaactcaaaacaatccaaacatccatcaagtaaatgaataaacaatggaacactactcagcaataaaaatgaagaagttattgatacacaaaaaaatctatcaatttctaattctgattgaaagaagccagacacaaaatatatatggtacattaaaaatcttagaaaatacaaactaatgtatagattaaaaagcagataaatggttttgtcggggtaggatcacagaaagagagatggacagtaaagtggcacaagagttc

SEQ ID NO: 413198 - DNA, 112 bp, Homo sapiens
acacacacacaattcaaaacttgaaaagggcttcatcagaagatgaacaggtcttctgcgaaataattcccaaccatcacaatgtaagttaatcacaggaagtaattttgaa

SEQ ID NO: 413199 - DNA, 558 bp, Homo sapiens
taggatgctgtagacttaaggagaaggcaaatttttagtctggaaggtgatccaattttaatagtggtgtttttgggaaaatgagattacagggtatctttcattatctctgagttttctgtttttaagaacatcacattattaagaaaaaagacatgcatttaaaaaattctctctcattttagctgccagatttccatggctattctgccaaattgagccaataggttctagcttccacttaaagcacagattttacattcagaattctgttatcttgaaattgttctaaggaagggggaatcagagtcctcaagtagcaggaaccatctttgaagtctgagaataaagtaaaagacttctacagcattttcaggcttctacttgcaaccctgcttccattcactagtaaagccatcagaatttgcctccttttcagtgtcaggcttgaggcttgagccagcactattgataatggagggagcttcttatataaattgggctatcctgacagttgcagggatacctgctgaaagcgaccctaatgaaatgcatggg

SEQ ID NO: 413200 - DNA, 291 bp, Homo sapiens
agttacccaagaggagtgatttcccgagctcttctgtacaacatagtgcctatagttaacaataaggtattgtgaacttaaaaatttgttaagatgatagatttcatgttaagtgttcttactattgttggtgcgccagttcaggttcttgactttgcagcacaaaagaatatgagagtgagttcaaagtaggagtaggccaagtaatttatcacaaagcaaaagtacactctgagaggcagagcaagtttctcagagggagagacagcagctagacccttaagaggaatt

SEQ ID NO: 413201 - DNA, 139 bp, Homo sapiens
atatgtgcatgtgtgtgcttgtgtgtgcatgtgattgcgtgtgcatgcatgagtgtgtgcctgtgtgcatgtggttggaagtgtgtgcaggtgtgtatgtgagtctgtgtgtgtgcttgtgtgtgcatgtgattgtgtg

SEQ ID NO: 413202 - DNA, 175 bp, Homo sapiens
aggttttttcttgccaggcttgctttggaactgcacctttacatcctttatattcctttaggttggttgtgtctcttcttgactcatgagccttacctcttatttatttttattaccatacatctggcttacatttttattttttattttttttttagagacagggtcttgctac

SEQ ID NO: 413203 - DNA, 192 bp, Homo sapiens
attttacagcctgcgaataggatgagacttttaattattccactaacctataatctaattcttttccccttctctggcagaatgggtctgttgaatctcttacctgtctgatctttggtggttagacctacagagctggagaggctcataaaatcatagatcaatatcctcaagcagaaggtattttttgca

SEQ ID NO: 413204 - DNA, 409 bp, Homo sapiens
gcatttattgttgttttaaatagcaaatatatatatacagggtcttttataatctgatcttctgtgtttatactctctgtgacttctagatctaaaatgtgcacaactacatggctaaaattcaattgcgtcctccatgtatcatgtgtgttaacttttccaggctaaatgagaattgatttattataaactgtatttctgactgaagtacctcccatgctatgtttgcctgaggacagagccttctaattctacctgtcgtctaccactctacccccacactgtttctatccgctgtattccaggttcatcctccatactgctgtttataatcgcctcaactccaactttagtaatgctctacctttagcaaaaatgatggcttataatgaaaagcaggtccacagtg

SEQ ID NO: 413205 - DNA, 460 bp, Homo sapiens
tcagaaatcaccacaaaggaacttatcaatgtaaccaaacactgcctattcccccaaaaccttttgaaataaaaaatagttacttccaatatatcatcacatagaaagaggaatgaatacattcatttactgcacaatttatcaaaacttgttgaaaagcattctacttagtgtagaaaataacttatctaaaggactacatgtaaaagctacctttgaacatttgaaatttatcatgagaaaaagaacagacttgatacatagctctgaagattgcacatagagttactgaatgaaaatgacatatatggagagatttgggttcatacaggggaagatagttttttaaaaatggaacagcatgaccataggtagagaatatggatgaaacacatccatgagaatgaaagttagaggaaaacattcagctccatcaagaggcaaagtctctaggttcacg

SEQ ID NO: 413206 - DNA, 546 bp, Homo sapiens
gaggatacccgcagcttaagggctaccctccttagtgcttcttttttattggattctattgccagtagctagaagctactaatttattgaggctttaccctgatactgtttacaatgcatcttttcaggcatatatcatatttgtggatcagacattgacaattacaaggcactgaaatgattatattcaattgccacaattgaagcccctgaaataggatacctgagataatgcattccacattcgtgtctcatttgatgatcaatgtattaatcagaatcagagatgatagcatattatatacttgtcaaaataaacttattagaaatatattagttctagctaaaatcttgcattgatttatcatttgttttattaatagtaagcgttacacctgctctcaaatcttctaattaaaagaaatctgtttcctagacagattgaagttaaatggttagcataattcctgtgtgtgtgtggagagaaaagatagtagctcactggcatactccattggcatgccttactttcaggaaaacagagaa

SEQ ID NO: 413207 - DNA, 446 bp, Homo sapiens
ctgcctcagccccaccgagtagctgggactacaggtgcatgccatcacacctggctaatttttatatttttagtagagatggggttttgccatgaaggctggtctcgaactcctgggctcaggcgatccacctacctcagcctcccttggagatgttatttagcactgtgcacaaggaaaagacgatgggtgatcgtttacaaacaactttgtgtgccacaatcacaaaaagtcattttacatgctcgaggaatgccatcatggaggtttttgttttttaaattttttaatttttttttgagacagggtctcgctgtgtcacccagactggagtacagtggcacaatcatggctaactgccaccttgatctcctgggctcaggcgatcctcccacctcagcctctctatagctgggatcatagttgtgtgccaccatgcctggcta

SEQ ID NO: 413208 - DNA, 303 bp, Homo sapiens
ggggggacttgcccaaggtcactgagctggcaagagggctctgggacttgaacccagacctgtctgatcccaaagcctttcaccacctcatttctctgcacttacctgggttgttccccaggcctcttgtgagggtcaggaaaagccttcagaagggcttgcccagttgccaattgcattagtttccctttcttgtcgactggcctggagacaaattcccaggactacgtgtgggaagggctggctcatgaactcagcttcaacctacttttttctctctttcaggtggagcaacaccgtcag

SEQ ID NO: 413209 - DNA, 419 bp, Homo sapiens
gctacaggtaaattgaaacgttttctggttgacaattggttgagtttgtctaaagaccggagatcaataggaaggaatgtttgagttgtgataagaggttgtggagaccaaagttttatcctgcagatgaagctttcagctagcaggcttcacagagaaacaggctgtaaaatgtttcttattagactgaaagcctgtgttgatattaatgccagagaggcataatgaagcatgtctgacccccatttcccttcatggcctgaaccagtctttcaggttaaattttaagagccctggctgaggaggaagtcctttaaatgagggggaggcttagaatcttacttttggtttataccgcttatattcaacagtaataattgattgtgattattatgatcatgtttacttggtccaagatg

SEQ ID NO: 413210 - DNA, 225 bp, Homo sapiens
tcctggtgaccattgggctgatcttggcttttatgcagaaggacctgggaagccattgcagggtgctgagcagagaagcgacatggtctgacaactcctgggtgctctgtggagagtggactgtggaggagtgaggaggaaagtgggggctgattagaggcttccgggccaggtgtcaggtcaaacttgggggcaaggtgtatatgtaagtggccaccaaggggg

SEQ ID NO: 413211 - DNA, 241 bp, Homo sapiens
ctcccagcccccaccaaggacttcccctgctcatctctcatgtccagatgtgtccaggtacagttggatcccatttgggattggatcccatcctgggctgggacccaggatgctgatgtgtgagatcttggaaaatttcctccgccttcgacggagaaattggagttgctagtctggcagtgaaccagtgaggcaagaaagggggaggattcagtcaaagccaggaaagagggaggaggag

SEQ ID NO: 413212 - DNA, 528 bp, Homo sapiens
gtctctacatcctcaaggaactcataaccaaaagaatatggtatatgatttcattttaaataatttcatttttaaagtctggtgattgtgtgtttggaaaggggtggtgaagacatgacaaggaattacaggtcaatgtacatcagtgggaatcagaagcacaaggtctctgttcttttcatgcaagagaggtatctattgtcctaggcttcatattgcatatgatgtatgtacaatgcccacaaccgtttacattccatgaagatctaatgaactccagttctgagtgggttcttcaaactctctccattcagagtccagactgggtacccagaacatctggtagcacaaatcactgaagtctaccaaagatggcaatctttttgttttatggtggattccttttttttaagtatgttcaccatggacagtatactcattaaaatatgtactgaaaggtatatttattctgttcaaagttcagctgaaatgtagtgggggaaaagcttttactgtttctttataatt

SEQ ID NO: 413213 - DNA, 337 bp, Homo sapiens
tgataattgatgagttagtaatttaataaggagtctaggaaagtagagtaacacctaaagtttttgaacatgcgtgctaacatagggttttctttttttcctttggtgaacaggaagaaagatttggtgtggaggaggtgagactaacttggtaattatagaagactagttaaagtaacatgaaggatagctaaatttttggtagaaaagagcagatattctcagcctcctccctttcatagagtaggttggggcagaattacttaaaccatgtattcaaaataactgtgtgaacaactctcaacccttttgataatcacggtattgaaagaggtta

SEQ ID NO: 413214 - DNA, 451 bp, Homo sapiens
gaggtgcttctgcagccgcatcgcaggtgtttacggatgtgcatttcatcctggcagcagtcccaccaagtggattgcaggtgctgttatcaacccattttacagatgggaaaactcagatttaagtccttgcccaaggtcctatggccagtgcgtcataggagtggaattcacacccagacagagcccgggccccccagctgccttttgaggtgaagccaagggagagaaggtgtagcatcccggcctggcccctgccgtcctggcggaactgagcagatgtggggcttcagcctgcaggagggttgctgcgggcacaggggagtagtgagccttgagggacatctcagcattaaggttcaaaggggaagcctctaaagacgccactcatgctagggagcagctgtgcctggtgctgatgcctgtggagggaggtggggggatcgttcct

SEQ ID NO: 413215 - DNA, 198 bp, Homo sapiens
ttctcaccgttcatggaaagaagtcaaaataataatgagttgtgatatgaaggagtgatatttctttattacctatgccaccaaggggaagagcagaaagcaattccactcttcaattggtggagcaaatacagggtttctttttttttttttttttttttttttttttttttttttttttttttttttttgggggag

SEQ ID NO: 413216 - DNA, 331 bp, Homo sapiens
gccccctcaccttcccacaggatgagggttctgagatctttgccgattccaagaactcatcatcttcagctttaggcctcacctttcctgaaccctagataggatacaaggaaatggtcacaaagtgagcagggagaagatcttggttccaatcccagcttagccatcgatgacttgtctacccacctatgccgtagacaagtccctcggcctccctgagcctcatttctagcccctgtaaagagagtgttttggtttgctctggttgcataaccagcacaaatttagcaacactcagcagggaatgttcttttgtttgtttgtttctttg

SEQ ID NO: 413217 - DNA, 552 bp, Homo sapiens
ccaacacgcccacagcaccgcctggtggttcacacctggagtagcaacttctcaaagcctactcccaaccctggctgtagaaggttacccaagcatcgtacttactcccttcactctggctgtctttgttcgagttgtagacctggaaaataaaaataaaaattcacttatgtgcattttatgccaccctataggttcactgtagaaaaccattatcttcctcattttccctagtttgcaccatgaagtggaaggtaatttctggctcccaaacatgaacccattcaataattatctacttctcagtatttactttagctgttcttaagtgtgtgtgcatcagaatcatctgtgcaactttattgtgtaaaaaaaaattccctccttttaagaaagcaagtaaatgtatatgcgtacataaatagaaaagagaaaaaaattaaaattagttacaaatcattaagcatgaactgcgcaccaggcaatgtgctaagcatttcacatgaatgatctgaaatcatcaacatgacaattctgttgggcaggagctgt

SEQ ID NO: 413218 - DNA, 486 bp, Homo sapiens
ccaacaccagcaaaggaaaatggcagactggagccgcagtgatggcgactgcccctttccgtgggaacttggtagtcttaggcagtgtccagcctgctgctgctagccacaacctgagcaggttgcacagctctgtgcttgggtcccaaggccttggtggcgtgggctcatgaggggatttcctgatccatgggatgtacagatctgtggaaaaagtctggtttcccgcgcagggtagcacagttactcaccacctcccttggctgggtgtgggagttcgcctttgtggctaccaggtcaggttgtcgctctaccctgcttttcctagctctgtgtggatcacaccaaccacctagtcagtcccagtgagagaacctggatacctcagttgacggagcaggattcactggccgtttttgctcctcttagtgggagccgcagactggagtggcttctaatcagccatcttggctcctcctgcctaaa

SEQ ID NO: 413219 - DNA, 472 bp, Homo sapiens
ggttcacccctccttaggcaacctggtggtgtcctgttcccaggggtgttgataccaaactaatcgtggaggtttactgggcataatgtactacagtccagaacttctggattctatccatttttctgccttcacctcccaggtaactgggactacaagtgtgtgccagtgctcctagctgaagctctgattactgattttttatctttcttacatgtgcattcaaactataagttttcctccaagcactgcttttgctgcatcccagaagtgttaaattgtattttcattttaatttaaagtattttaaaattgctcttcacatttctctttgattaatgtgtttattcagaagtactttggaattttcctatgttttgttatttatttctagtttaattctgtggtctgatagtagacattatatgatttctatacttataaatttgttaaggtgtgttattacccagaa

SEQ ID NO: 413220 - DNA, 515 bp, Homo sapiens
tgagaaagggaaaactgagctgagccttgtctattcaccctgactccccgcaaggtctccagtgggggccaagctccccttctaggggagagggaagaaagcagggggcagggggagcatcttgtgtgaatcatgtgagagttttgcagatgctgccctaaagtagccctaaagtagtgtgtgatgatggatttgacagaaccttctcaagtgccactaactcacacacatttacattatcacaagctgtgtggctgcccctcaaaggcactgccgaggttgaggatcacaaacacaacgcctgatcaagcaggggagggcagggtgctgggcattttttaggcatgtgttaagtaccaggcactgtgccaagtggttgctatctaatgggataagaggtagacaagattcttttacacatgaatccagggatcttagcagggaagcaaattacccatggccgtgcactaaggcatgtagtcagtggcagaaacatggttcgagctctagtatct

SEQ ID NO: 413221 - DNA, 236 bp, Homo sapiens
ggatgggctgtgggcagcctggagggagagcagggatcttctggtcccagctccatcctgactcctttgtgaccttggccttccctgctcagggccttgccttgctgcactgcctgtgccgtgagtgagaatcagatgagctcatgcccgaggactcctgggctctgaactccagatactgccacatggaggggagtggtcagtgcttccttttcccctttgaaaacatcctcgtg

SEQ ID NO: 413222 - DNA, 168 bp, Homo sapiens
ccttctaaaagccaaacagctggttcccatttctccttctggtacttgttcatatattacattagcaaagagactatccctttagccagttttacttctcttccttactactccctgacaaattatatatctatgtctgtttcccccctactggcatgagaactccag

SEQ ID NO: 413223 - DNA, 107 bp, Homo sapiens
gtttccaggttcgctgggaagcagtagtcactgcattgtcccttagcccttcctgccttttctttctccttactctcacatcagcaagtaatctctgcctcacactc

SEQ ID NO: 413224 - DNA, 502 bp, Homo sapiens
tgcttcaagagtttggctcctagtccatgtttattaattgtttgctgaaatgaagacaagtgtgagatggtaatataacactaaagtgtgctaataagtccatggtgctatgctgaaagtgcaaataagaccttgcaagtaagtccatggtgttttggatttgatgttagcggtagcagaaagccactaatataagccttgaatggtgttcagggatcttgtaaactactgaaaagtgaggaaataaatgtatgtccaaggtcattcatttatttagcggcctttaaagaggaacattttcactgtgagataatagttgctgtagtgacttatttaagcaagattacaggctcttctctaaacagggctgcacctctccattcacggcacaagaatgcacaatagactggattttgaaatcagtctgccttctgctaaccaagccatgcaccctagtgtagggctgcatctcctcagagaaaaggacacatttttccacttt

SEQ ID NO: 413225 - DNA, 529 bp, Homo sapiens
tgggtatcacgcactgggaattgtgatgggagactgttcagaaacatttaagaactcagcaaacttgtagctatgatcaacgaataaggctagaagctagagtggtatctgcaatccacatggctcaaatcccatattgagagttgcatcaatcctgcctgcattcgagggttctcagggcaccctgtttcttgctgccagcaggggttcctatgctggccactgtctacaggagtgagagtttgttcccactcgctgtgtgcttcccctaactgcaggggctggaagcctgggaaatacatttcccagcatccctgtccatagcgctttggaagtagttgagatctgaccagtgatagctgggacgggcaggtgggcgaggcaagagccttccttcctctggcagtggtagaagctgctgtgtagctgccccagaatctggactccagaacctgccttcttctacctccaggcagcggggcagctgcagattctgccctgacttcctgaagcttcgtggcctgtgggc

SEQ ID NO: 413226 - DNA, 345 bp, Homo sapiens
tgggttggggctttgaacaggtcagaatcgtccttggcgtctcctggcctctggcaagtggtgggccggccatgtgcccctcacaagagctgttctccaggtgctcagcatgtgcctgcattgtatgtcagctgtgatttgccctcagtgtacattttattgtagattgcactgaaatatacacaccatgacatttaccatttcaaccacgtttaagtgaacagttcggtggcatttaggtgcattcgctcacagtgtgcagccatcaccaccatccctctccagaactttttcatcattccaaatggaaactctacctattcaacaactccccaattttccctc

SEQ ID NO: 413227 - DNA, 396 bp, Homo sapiens
tgccttatttgtcaggggccattacttggtccactttgcatttcctccaccatccaggcccactttagagctgaagaactgaggcttaggaaggctaaattttcccaagttcgctcagccaataaatggcaaaactaggattcaaagcaggctgtctagagtccaagctcttaatcaccgtgctaggatcccctcccattttgcagccttggaaatgggtttgaagaggctaaatggcccaaagtagcattaacagtagtaacagcagtaagagcaagggcttcggagtcagacaaacctgggcttgagtctggcttagccccttcctagctagcggatctgggcaaattatgtaatcctcctgactcccagtttcttcatctgtacaacagggat

SEQ ID NO: 413228 - DNA, 562 bp, Homo sapiens
aggcaaccactggaccagctgcttggtcctcaccacctcctgcttctgccaatcagtgtggggaaatctcaacagtaaggtggcttatattccctgcctggcagcctcagagcagagagaagagccttgataccagggcaacatcagggaccctggagctagggctccaatatctcatccaaacagggtcagtgctttgtggtggctatggaggggaggggctgcgtgtaaggtatattctagcacggctcaactccaagcattctctttctttgtctatgtatgtacagataattacatggccgatttgcttatcgctggccaaaattaatctttcttttaagaagtgccagctgggtcattaagacagctcagcctgcatgcagtaaattctactcagcaaatatttattaacccagttccacgggagtactgagaaattgaaacacacagtctcacccaggtagtttagattgagtacccagtataaagtatcttgaattactttctgctttctctatcttcctactttctgcagtaggaagaaagtgaccctaggtgg

SEQ ID NO: 413229 - DNA, 400 bp, Homo sapiens
agacgtgctgcccattaaggagacagcctcataaattggctggaccagaaactaccattggaatcagacctgcttgctcctccggagatgttgcaagctcttcaccagggaaacagcggcagaaactgatcccctttccaagatctctggcctttgtttttccaagggaaatgcaatattgtccctggggaggtaagaagccagattgatttgccggccaaatgaaaggcgggtttgtcggttctcctgctggctctcccataattgtggagtccttacccagagggccccagtggcaggagtattggggcagttagtcacgccctgcagggttctgactacgcctgactccttctccacgggggaaaatcctgtgtattctatggcccagtgctgattc

SEQ ID NO: 413230 - DNA, 172 bp, Homo sapiens
cccagatcattgtcagtgaggattgcaggggtcctcaacatccaaggctgcaggtatccataccagcagcaaggctttttttagtctatagtggcagaggctgctggggacctcttcatcactttttctcccatgggagacattgtggccaaggggattcttcttggcacag

SEQ ID NO: 413231 - DNA, 430 bp, Homo sapiens
aacaagcaagctacagagcaactacttaaaagaacattttaaatcaatgttccaaacacgtaactctcttaaagtttgtcactgcagggctaattctattaagtaactgttaatcctgcacccctacatagtgacccgccttggttagtcagcagtcatgtattattaccaaaatattacatagtttctgtcctggtggataaataattactactttgaactcccctagccctcaactgttaacctgccccatcagccagataagtaggaccatgtaatgatccagcaatgaggaaatttaagcctgattgatataatacgggcctccaggatgcaatgtctacacaaagaccaattctgattgttcagcgtccatgccttatttaggtgttacgagatattttgaatataaactctgatttgcccattt

SEQ ID NO: 413232 - DNA, 428 bp, Homo sapiens
gggtctccccatattggccaggctcatcttgaactcctggtctcaagtgatccgcccgcctcggcctgcaaagtgctaggattacaggcgtgagtcccctgcacccggccttattgtcttttttttcaaaaattttcatctgattggttgaacctgcagttaaggaggaacaactgtacttcattcgctaaggctgggttctagatctagctgctccatgaggacttccttgcttaatttttttttttctggactgatttttatctaagcttctaaagtacggatagccttaacataaatttcttttctccctggttaaaatgagaatttacttaactgccaaccttcacagtgctaggtgcacaggaggtagtcaggtacttaattaagcctgctgaaactccagggagtacccccagggacatgca

SEQ ID NO: 413233 - DNA, 153 bp, Homo sapiens
gccgctcactgagatgtgggctctgtagctcttcagcacaacgggaactgagtgtggaaggtggactagggttttctgtggaagcaaaactggaaaaaatagaagccaaagtgtgagagtgtgtgggtgccatgcctgtgtgcggctgaaatt

SEQ ID NO: 413234 - DNA, 499 bp, Homo sapiens
gtgccactgctcatatgcgtgttcccatctagtccttgacagcccacgaggcaggcctcggccatctcccaagtctgtgccatggaccggcgagccacgcccctacctgaagccaccctaacaccattatcacgatggctccccgcactgctcctgccatggccgggcactgcactgcaggctgcacacctttaccacgggagtcctcacctcacacaaccctccaggtagattactgttagtgagcccactgtgcagctggggaaactgaggcacagactaattaagtgaactcatcctactgagcacacacatggacgactgtgcccagcagcccctggaccttggcccagctcctgaagtttggaatcctcctccatccttttctgctggtcacaaggttcccctcacactccaaacagtgtctctggcccacctcctgcactgcccacttggctgaaaccactttcctgcaggagccgggcactggggctggaac

SEQ ID NO: 413235 - DNA, 198 bp, Homo sapiens
catcaccacccaggcggaatagttggccatagatgatggcctttatagctttggttttctaggagtaaccaagagaagggatggaggtaacatttactgacacctgctgcatgccaagtgttatttttattcttttattttttttttaagacagttttgatctgtcgcccaggctggagcgcagtggcacgatcttgg

SEQ ID NO: 413236 - DNA, 370 bp, Homo sapiens
gtagagacagggcttcaccatgttggccaggctggtctccaactcctgacctcaggtgatccacccactttggcctcccagagtgctgggattacaggtgtgagccactacgcccagccccaaaagtttcatgaaataaaatcgatgcagtttaatattttctcttctgtgctatcctgtcttatatcatttaaaacaaaaacaaaaacaaagcaaaacaaaaactagtatagatactctaaaaaatcaagatactctgtgaactggtcaggacccaagtgtgaaaactttgtcctagaccacttatttttcttttttttgtttttgtttttatttgacatggggtcttgccatgttgcccaggctggtc

SEQ ID NO: 413237 - DNA, 205 bp, Homo sapiens
caggctccggcacccactcacctcgcctggaggcaaggagggggcaggtgtgggtgatgtgctctgacaaatcgtgcgtggggcaaggagaaagttaagacaacccaaggatggagaggaggagggagtaaaggattttacggggttttctatgcaaccttcctgtggctgtggttcagggaatggtttcttctaaatatttggt

SEQ ID NO: 413238 - DNA, 321 bp, Homo sapiens
aatcatgaaaaaaaaagtcaagaaaattataaaaccagacctaacaacaggctggacctgaacgtctgaaacagcagccactagccacatatggctattgagcacatgatatgtggctaatcgaaattaagagctgctgtaatgtaagctacatactgggttctaaacatttaggaatgtaaaatatcttttttgtgtgtgactactaaaaatgttgaaattacatgtgtggctcacattaatggttctattgtatagcactgatctgatctagggcatttcaggtaaaagcataaaaccctaagtactacaaagattctc

SEQ ID NO: 413239 - DNA, 422 bp, Homo sapiens
ggcggttggggctgcaatgtgcggagatcaagtcactgcaatccaggctgggtgacagagaccttgtctcaaaaaaggaggaatatctaagagaataaaatatgcttacttgctccaggaataaattaaaaaatataaactatcaaccacctttagtggagaccactagctgtacctaactcaattctgtacttttttccccaacttttcctgggcacatgactacctggaatgaaagctatattttccatccttccttgctatttacaagtaaggcattatgactaagtttggccagtgacatttaaatagaagtgttgggtacaacttctgggaaatttctttagacaggggatgtaactttctcactgccctctttcttgctggccagagtgctgctgtgagggctagagcttcaccag

SEQ ID NO: 413240 - DNA, 288 bp, Homo sapiens
cagtacaatcaccactcactgcaaccttgatctcccagcttaagcagttctcttgcctcagctgcctgattagctggaaccaaagacgcatgccaccatggctggctaattttttgtatattttgtagagatgaggtttcgccatgttgtccatggctggtctcaaactcctgggctcaaacagtctgcccacctcggcttaccaaagtgctgggattacaagcgtgaggtactgtacctggctggcttcgagggaggtattgagcagggaggtatttctggtagctc

SEQ ID NO: 413241 - DNA, 350 bp, Homo sapiens
aaagatgggaggggaggattgcaggtgagtctagcatttttagcttcagccttttgctttttctttcctggactacatgcacatgcaaatttggggtatttctgtattttgtgctttaaatttttttcttgttgggccttaattcttgttgggtaccctgggaagagtaaaataaagttaactctgaaccattcttttggacttgctgagggatcagggcaccctaagtgaccaggggcacttctgctttcagcagaggatggaggaagggctgtgcttagcattctgaaggcctcgttctgagtttaaaccaatccagccttctttggactcctgttgttcccaagaca

SEQ ID NO: 413242 - DNA, 336 bp, Homo sapiens
ggagtggagaaggggagaagttatatgaagtaaatctggttgcttctgtcagctttctcctttgacaccttgggattcagctttctctgacttgagtcagtttcctcttgaatttctttcttgctttcagtgtttgtttctcattcctcttgtctttttaaaattatgctccccctcttaaaattttttttctgtaattttagtagggttttagatgggagtgaaattatacatgtatttaataatgggcaggtggtcttactttctactcacagataaatactgtctggtgatatctgcctctgtgactctctcggtctactagcttatctgtat

SEQ ID NO: 413243 - DNA, 396 bp, Homo sapiens
atccaatttggggtgcttgcccttttagctgcaggggtaaggtgtggggagagcccagtattattgggggcagtgccatcagagctctgtgacagccagagggtcttgttgccctcccatttgtccctctcctggcctctcagacccttccccaggccagccctcctgagactgccctcaggactctgaacccccaaacaagaaggctttgtattatggagccaaagagcatgggtttaggaggccttggccggcatggtgcaagcagtctgtcaattctctctgcctgatttttgcccctaatcactttcctgtcctgggtgtgatactccaggaaaacctacaggaggccttggggtgtcagcttgggatgcttggggttcaggactctgaccc

SEQ ID NO: 413244 - DNA, 383 bp, Homo sapiens
tcagttggcaagatcctgagaatgagggtcaaagtgggcagaaaagagagcaggatttcaggattttttgtttctttcttgaggcagtgtcttgctctgtgactcaggctggagtgcagtggcacgatctcggctcaccacagcctcaacctcctgggcttaggtgatcctcccacctcagcctccccagtagatgggaccacaggcatgcgccaccacgcccagctaatttttgtattttttgtagagatagggtttcactatgttgcccaggctggtcttgaactcctgggctcaagcaatcctcctgccttggcctcccaaaatgctgggattacatgagtgcgccactgcacctggccccgagaacaggattttaggtc

SEQ ID NO: 413245 - DNA, 237 bp, Homo sapiens
atcccatcagacttattgaattaaattgctggagctttggactcagaaatctgcttttcatggggctgttggctgtttgttttatattcagtaaagccagacctggacatcagtggcttcatcctcaccagcttcatcgagtgggtctttattaataatataaatattaggttggtgcaaaggtaattgaagtttttgtcattacttttaataactttccttcctttttttttcttc

SEQ ID NO: 413246 - DNA, 339 bp, Homo sapiens
tcagaagagcctgattagtttggccaaggagatgtcaacctgaaataaatgaaaggttcagaattcagcgttaaaatgtttattcattctgcttgtgggaactaatggtaaaaattaaaaaagagtttattcaaacaaaaatctgggaatagccaatcagggcacacagactccagagaaatggggtcagtgctgcaaagtcaaaagtgaagttcttgcttacatagaaagaaaaaaaattaataggatcacaacattttctatataaggctgctttaagagttacaacaaattaattagttgcagaattttttttttttttttttttttgttattgtt

SEQ ID NO: 413247 - DNA, 380 bp, Homo sapiens
cctttattcatgccagtaactttgctggaatgcttcccaaatcgtctccacccatcaaaatcctacacacacttcaaagccccatcaaataccacttcttctatctgtagatctactgactgggcagctagcacaactgtgttgcagtgttctagggcgagggcctctggatgggttatggggatgccgtcccatgattaaaacaaagtcttgaccctcatggagttgatattctggtgggcactgaatgtggggaaaacacctcagcaccaaggtgcttttttctgctttcttaacagaataaggtattaatgacagacaaggaaacaggcttagagaggtaagatactcaggaaaggtatcttgcttagcgttcaatc

SEQ ID NO: 413248 - DNA, 312 bp, Homo sapiens
cagtgagctgaaatcatcacaccactgcactccagcctggggaacagagtgagactctgtctttaaaacaaacaaacgaaagactgtatttttcagttctagaatgtccagttaataatattttatagatttcagttctctgttgaaagtctctttttactcatcttttccccttttctcttaattatatagtccaaatctttaccaattaactacaacttctcaatcatttgtcgatctgattcttttaactcttttttctattgaacatccatcaaacttttcctggtcacattttttccttccttgtgt

SEQ ID NO: 413249 - DNA, 479 bp, Homo sapiens
tctggctatgtattgttgaatgaaaaggggacatgtaaatctcgtttcagctgttctgaaataacccttgccacatgggaacacagtctattcaacatgaagaattcaaacctaacacaagtgggtgagaagcaggaacccactgctaggccccaccgcgttccctcagaggtggtctcagtagctggaacttggagaagtagttttggtggggtgttgggacgtgggtgaatccaggtcctggtttggaattgctctggtgggaaccgtcagctaacgtcagttggaagctctgtgtcctccccctcctgagtcctgtttttcctggaggaccttggcccacccctgtggaatgtggggatgtggggaagaaagctgactgcttttactcccactcagaaaattcggttgcgctcttcttcaagggggtgctcctcagcctgcaccccagtgaaggggcctctgaggaactcccagtg

SEQ ID NO: 413250 - DNA, 204 bp, Homo sapiens
tggctaaactgacttagcagtgtcttttgctaaaacttgactttacaaggaaatgcacagatgggcctaggagatgcttcggaagcctaagatttggtcaagcagagaatctttgtcagttggcatcgttaggcgacacagttaaccctgggtgcccctctctccctatgctgcctctgcatccctgtccttccccttccggga

SEQ ID NO: 413251 - DNA, 280 bp, Homo sapiens
tcctagtctacatttgatacagttttcaaatacagtcttatttatctgcactaagttgtcactttcataaattagactaacatattatcctggttttattattttttttttaattttgttttttggttttattttaaataaaggaaaaaacagaaaccatataaggctaattatatggataattcttttcttttttttttttaagagataggatctccgtcggtcacccaggccagagtgcagtggcacaatcatagctcattgcagccttgaacttcta

SEQ ID NO: 413252 - DNA, 243 bp, Homo sapiens
taaggcctcgggtcagatcctgatgggacggggtggccgccacgtcctgggcttggggatttccaactcagaagtgggaacctggccagctcagttctcggctgcccttcctgaggccccaaatgaatggcgtgtgcatcttcgtcgaagatattaatacgccacccccagctctgcccacaagacacacacccaccctaagaactgtccctgacaagccaaaattcagactttcaggatgta

SEQ ID NO: 413253 - DNA, 388 bp, Homo sapiens
taattagccagtgaggttttgtggagctgatgtaatgttggcagaggctaatgttttatggttgaacatgtagcctcttgagttttagctacagggctaaaaggatgacatcctgaaaagctaagaaattcatacccataacaccaccacttcgcaatgtgcatcttaaaagtaatttgtaaactttaactgatccatctttatcatgattagttatgaacatttgttaaactataaattctctaaattttattttatgtaactattttgctatgaaaagaaatttctaggtaacacagacaatttagaaagcttaaagtaacaaaataattagaagaaaggaaagttttacaaggagtgagtctgtttgtggcactttcatcccact

SEQ ID NO: 413254 - DNA, 371 bp, Homo sapiens
tatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttccttattgttgcttacttatcaggtctccacataaaggtgtggaaacttcattcattcatatcttcaacacaaattgtaggtagcctgttttttaaaacatttattcaacaaatatttagtccaagccactattacttactaccttctctactatt

SEQ ID NO: 413255 - DNA, 364 bp, Homo sapiens
gcagttaccagcagaagggtttactgggatcagggtgcatgggggtgatggcctgagcaaccctccctctcagcacccctccctcacactcggttaactgaagcagcatgcagcttctggtggaagctacagggcccagttccagcccctgggcctctgccctgcccagctggacccgggcgcattcacatctcaggatctgggtcagacattgtcagataggaactctctgtggacagagcccacacctcctgcaccttctagctgtgcctaacaccgggtttgcttccccagaagtgctcaggatggcaactgatgattgctgattaagacaggctatctccactctgtgtagcccgttccc

SEQ ID NO: 413256 - DNA, 399 bp, Homo sapiens
ccagtgcaggggtccaatcagatggacgacatccaatctgtatttggggcacacgatagcaggaatccacttagccatagggctgggccagcagcagcctgagcaggggagcttgctaactcacacggggggcaccccagctcagccattcactgtctctctccatgtgggctaggggtgtcaccgctgtgaacctcgttatcccatccatacaatggacatcatgtttcctcccgaccaagtggtccatggcaggtgcctggcatccggtgggcgcttctttcaggttgtgcagcacagcacgccaaccagctatcctggagcttgtggcggaatctcagcttcagttttctcttctttttttggtttattattatttttcttgaaacggagtctcac

SEQ ID NO: 413257 - DNA, 318 bp, Homo sapiens
gcccagtgaggttgtttttttgagacgcagtcttgctctgtggcccaggctggaatgcagtggcgcaacctccgcctcctaggttcaagtgattctcctgcctcagcctcccgagtagctggactaacaggcgcccgctgccacgcctggctgttttttttagtagagatggggtctgaccatgttggccaggctggtctcgaactcctgacctcaagtgagccacggcgcccagcccacatttgctttcaaagagcagtgacatgaggagtgagccccagccggtctgaggctggaccacccgctaagcagtgagct

SEQ ID NO: 413258 - DNA, 374 bp, Homo sapiens
ttccgggaaaaggttccatcccagcaatcccactcacgaaaatctaccatgaagatacccttccaccaatgtgaaaatccatatacaccaggttactcacggcagcacagttcgccaccgtaagagcctggaaacaaactaaatatctacatgcaggagagacactgcgtggacttcgctgcatccctgcaaggaacactacgcagctgtgcaggggagccaggaagagctccctggccaatgaagtggtttccaggacacacagctaaatgaacagagcacagcgccactttcacgtgcgaaagaaaaggtataaggccaggcgccgtggctcacacctgtaattccagcactttgggagcccacttgagccc

SEQ ID NO: 413259 - DNA, 380 bp, Homo sapiens
taacaaaatatgtctgcacttctgacccagcaatcccactcacgaaaatctaccatgaagatacccttccaccaatgtgaaaatccatatacaccaggttactcacggcagcacagttcgccaccgtaagagcctggaaacaaactaaatatctacatgcaggagagacactgcgtggacttcgctgcatccctgcaaggaacactacgcagctgtgcaggggagccaggaagagctccctggccaatgaagtggtttccaggacacacagctaaatgaacagagcacagcgccactttcacgtgcgaaagaaaaggtataaggccaggcgccgtggctcacacctgtaattccagcactttgggagcccacttgagccc

SEQ ID NO: 413260 - DNA, 298 bp, Homo sapiens
cacacacacactggtggggaggcaggtgatgatgggttgtgtcatgaatgcccaagtctggcggtgcatttaatggagtagtccagggaagcaggaggaaactgaggaacagggagggcaagcttgaggaattaaggaattacctggactcacggggaggagctcaaaagacgaattcgatctttttctaaaaacattttaaacagtagtttgcctgactccaaatcaggaagagacagctttacctcatctctcctgcctcctagcctgtgggctccattagcaagggatgaactat

SEQ ID NO: 413261 - DNA, 179 bp, Homo sapiens
actgcactccaggctgggtgacagagtgagaccccatctcaaaaacaaacaagcaaaaacccagatcactaagcaaagtaatgtttaattacaaattctcaatgttgggtttttaagcagaactctggacagaactggcaaaattccagaagacaacttaatctgacacccagaatggc

SEQ ID NO: 413262 - DNA, 284 bp, Homo sapiens
tactgtgtcccttatggaaaacctgagatttgtccagatttttggaacaatctgctgttttgggggaagaagctacattattgtatgactttcatgtaatcactccagttaaaatctgtggtttcttcattaaaaccagaatgagcctgggtgcagtggctcacacctgtaatcccagcactttgggaggccaaggggggcggatcacctgaggctgggagtttgagaccagcctgtccaacatggaaaaacgctgtctttactaaaaaatatataaaaattag

SEQ ID NO: 413263 - DNA, 173 bp, Homo sapiens
cttgctgcttggccagttgttccccagccactctggattcggatctaggtggaccctatggtatcctagaaactacctttatgttcttttcttttaagaaacagtgtcttgctctgtcatcctggctggagtgtagttgcatgatcatgggtcactgtaacatttaaactcca

SEQ ID NO: 413264 - DNA, 396 bp, Homo sapiens
ctctagtctcttatcatttcttcatatgaagaataatttatactcattgatgtaaattttgctatattttatacaacaaacatagtattattttaatattgcacatagagaaaaatacctcttcccctcaaaattagaagggttggtatttttattcaggcttattgatttaaaataactgcttgatccgtaattcaggccatacgatttcaccaaaacaaatatcctaatagttgtcatcttgaataactgtttagtgcacagaatgtagtctcatttattaagaagtgatttaagagattattacttctgcatctatcacactaacatgaccaactctttagtaagggaagagtaagggaacttattttatatctagatagaaattttattaag

SEQ ID NO: 413265 - DNA, 386 bp, Homo sapiens
agctcttacatgaaagggaaatcagaaaactattactttgaaaagaggcatttctggaaaggtcatccatttctatctgtttaatgtgaaataaggaaatcaataacatgtctacacaaatatgcattttataaggcatcattctcattatccctttattctaaactatagacactgacatgtcttgtcatattgttgaacgttacatttctcacgtaggaagacaaatggtgaagcatgccatcaaactgagccatcctatttctccttacagtaaacctgtgccttgtgggcctcaggggtcactgtgaggaggggaagtgcagggagcaggttgttcaccagaactctttctgtattgttttatttaaatatgcagctaactc

SEQ ID NO: 413266 - DNA, 333 bp, Homo sapiens
ttggaacaatgtaagcaacagagcaggcagaggcagtcaccactagaaaattcctttccttccatggccatagaagaagaagcctcataacacaaaagtatatgaacgctaacaactatataaaaacacatgtacatgtgagcaaagcccggaagaaccaaaaaaaccatatgaaaacagctgtgttagagtggtaataactagagtgggttgaagggggagcatctgtttaaaaatttaaaaatatttttaatttatacaactttaaaactgactttttaaaagaaaactaaaatagcacttgtagtaaaacttctctcaaattgctaaaga

SEQ ID NO: 413267 - DNA, 402 bp, Homo sapiens
ggaattacaggtgtgagccactgtgcccagccatgaaaaggccttctgtacaattataagaaagttagattctcaaccttttttcaactttaaataattaatctagtaacatcatcttaagatacatgataagcaggtattttttggactgtagactatcatacaaattgcagattatttccttgctgtatttcaatgcaggaacagaaaccactgcagatattttacacataagaggatttaacacaagaacctagctgtttaaaagaatgtttggaagggtacagacttactgagttttagaacgtattgccatagcttcaatgcagggaataggaaacagggctgctttcatgattaccacctctcaccacatgaagctcatgagcagacttggaacac

SEQ ID NO: 413268 - DNA, 426 bp, Homo sapiens
aggtacagattttcaaccacatggggagatgggggttagcacctctaaaccctcgtgttgttcaagggtcagctgtacttatttcttcttgtatcccccctcttcttttggtttctctgcctgattctcagaactcacatcgttcattccccatgtagcccctgagtgttgagcactagtctggttagaggtgaaaaagatgaagacctggttcttgcctttgaaagtcttggagaggggccctgggggtgttgcatgcactaatgaaaggcacaggagagggagggattgggcctgaggcatgctgggggagaataattcttctcccactgcttaagcaagagcatgccccaaggttcagctcaaggtcctttctttctctgtgaactccttgtcagcctgtaggatctcaccaccatctctgag

SEQ ID NO: 413269 - DNA, 274 bp, Homo sapiens
cttacataaagcattttggactttattcccagctactcaggaggctgaggtgggaggactgcttgagcctgggagatcgaagttgcagtgagccgtgattgcaccactgcactccagcctggatgacagagcaagaccctacaggggaaaaaaaagtggaacaccaggagctaccagaaactgaagagtcaaggaaggattgtcctctgagcctttgaaggaagtggcgtgctgacaccttaatttcggacttttggcatccagaactgtgaga

SEQ ID NO: 413270 - DNA, 752 bp, Homo sapiens
ggaatgcagaagaactaaccactgtggaagccagtatcttgactataatagacactgaggctagagacaaaacaaatacagaaaggagaaaggctagaatgaatttcatggtgttagatttgaatcagcggtatcactatgaaatcatagtttttaacatgtatttcaacagacaggaacagataaatgtagatatgtgtatacatacatatattcatctcccagctctgtcctctgagagagcctaagggtaataacatcttaatagcacaattagcacccagacggtggtttctaaacaccatccttcaataaaaagaaccaggactacttggagagatgtctggctgcaaaactgagacagggaaaatatcaggtgagcctgaaatatcttgtggtgccaaaaagtaaggaagtgctcaaaaaagctggggacttcttaaaaggaaagtggaaccaaactgaagaggccacatctggaacaatttaaaggattataacccataggataaaacaaacatccacaagtccatagtgataaaaaataaataactgaatgtgtagtacatggaagagaaggccaagctctttcttataggaaaattttaatggacacatgcaaaaaggataatggaagtagaaaaaccaccatttgacaaacaccacaggttaaagaaaataaggaaacataactaactgtaatgtttgatcctggattggaccacggtccaaacaaaagacattattggaag

SEQ ID NO: 413271 - DNA, 648 bp, Homo sapiens
gagtttgaagggctaccactagactgatcaatctgctaatgttactttccaggaatctcccttatgtgctattactaaaaagacacactgatatattctttaagtttctttccctctgctacacactcaaagttcccatacagctggggctttctgcggtaatctgttagacatcattctccataaatcaagagtttgccaagagaaacatttcttcaacataaaattcatgaaaatgtcttgaaaaagtaaattctcaaattcatttgatcaagttgaaaatcataagcttataccaaagcactcccatctcattatttttaaaatatttcataactcctacatattatcaggattatattaagactattatgagcaagacgttttcaattaaagtatctacttaatccacatgaacttcagaaactttaagcacagattattcttttgtattaacaacttccatttccttacgtgcaattacctgactaatcttctaaagagaaattatttctattagaaaataaagtaaaaaaaataaagtctatctgcaaaagaaaaattaccacttacattacaatatttctgcaaatactaagagataaaatcattataattgggaatccatcctagcaaagagaaaagctt

SEQ ID NO: 413272 - DNA, 453 bp, Homo sapiens
atttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaagg

SEQ ID NO: 413273 - DNA, 416 bp, Homo sapiens
caataaatacttccagagaacagaaaaagaagaaacactttccaactaattttatgaggacaggtaaccaaaacttgacaagaacatgacaaaaaaatgaaattacatggcagtctcactcatgaccacagatggaaaactcctaaacaacacattagcaaatcaaatcctgcaatatataacccaactaccaagttgggtttattctaggaatgcaaagttagtttcacattacaaaaaccaaccaatgttttccaccacattaatggaatgaaataagagaataaactatcttctagagccatacagaaatagcatttcataaaattcagcatccatttatgttaaaagctcttagaaaatgggcgtaggagggaacttaacctgatagaagatatctacactgaagcctgaga

SEQ ID NO: 413274 - DNA, 286 bp, Homo sapiens
gggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttg

SEQ ID NO: 413275 - DNA, 325 bp, Homo sapiens
aggtaagtggaaatacctggagtgtcattaaaccaccacccaggattattgccatggataaccaacctctggtgagccagggtcagaatctatcactcaaggcagctaagggctctttcagagaaagggcttttcagctgaaagggagtaggacaaacatggccaagaaagaatcacccatggcagagggaaacgtagtgagaacttctaaaaacatgtttctataaatcaggctgagatttcctctccttcacctacacaaacaatttgcagatgtggtcccagaaacatgtgccggagatttctgtgagccgtgggggcacag

SEQ ID NO: 413276 - DNA, 246 bp, Homo sapiens
gtagctgggattacaggtgcctgccgccaagcccagctgatttttgtgcttttaatagagacggagtttcaccatgctggccaggctggtcttgaactcctgacctcaagtgatccacccaccttggcctcccagagtgctgggattacaggcatgtgccactgtgcctagccagatagtagttaaaacatttggggagcatgactgagcctgtttagccatattggagattaaaaatctgatatg

SEQ ID NO: 413277 - DNA, 334 bp, Homo sapiens
tgtacttccgctcccacctcctttttccctcattgtcctgcactaggacgttcttttctcacctctttcaccatccaaatcttagcgatcccttaagtctcacctcctccagatatttccctaacaaatcatgaagtgtgtgcgagccaaagtgaggctatattgactccagttctacctttaaaactggagtaacttggccaggcacggtggctcacgcttgtaatcccagcactttgggaggccaaggcaggtggatcacgaggtcaggagatcgagaccatcctggtcaacacggtgaaaccccgtctctactaaaaatgcaaaaatgagc

SEQ ID NO: 413278 - DNA, 121 bp, Homo sapiens
ggggcagtgtttttagcgtttcctggcagaggtccaaggaaaggtgcatcagtgtgtcttaaaacatctgcagagttagactggggaaaggagcgactgcttactgtcctcttactgtgtg

SEQ ID NO: 413279 - DNA, 175 bp, Homo sapiens
caaataacacgtattaaccactacaactagcatagttttggctgacaccccacttgaaatgatctttaatgttctgtgggcttcaagccgtatgcaggtagatagagattaaaggagagctctaacagggctagtattagcctttctggtaagaattctacccacagtatgcaca

SEQ ID NO: 413280 - DNA, 432 bp, Homo sapiens
aagagaggattcacactaaggcatagagtgtgtgtagtgcctgttgcttgcctaggtgtctttaagatgctggaaaaacaaagggaccagggagccagtgagagaggggtaaagagacacataagggccagagacgactggagtttggaaatcttgacctagagttggattttttgccaagacgaatgaagaagacagaacacacacacacacacacacacaaacacacacacacacaataagagggtttaggcaggagttaaatgaccatatttagcctttttacaaaggccagtttggcttttctgcagagaatagagggagacaagatagaaagctgaggacgggggtgtcaagtaggaagtcactgcgatactactggtgcaagctgatggtcgcttggactaggagtggacagaaaagaaacggcca

SEQ ID NO: 413281 - DNA, 412 bp, Homo sapiens
gattgtcattccgaaataccatcctgtgaatggacacaactgtgaagttgggaaaaccctgtcaaagcaagagatggctggtgcttcatccagccaaagaggtcaaagtggttctggaaactttagtggtggttgtgcaagtggttctggtgggaatgacaactttgatcatggaagaaacattagtagttgcagtgactttgatggtagccatagtggtggtggatatggtagtagtgagtatggctgttatggatttggtaatgatggaatcaactttggaagttgtgtaatctgcaatgattttggcaattacaacagtcagtcttcacattttggacccatgaagggaggacactttggagggataagctgtgcccctgtgacagtggaggccaatactttgcttctg

SEQ ID NO: 413282 - DNA, 560 bp, Homo sapiens
gagacttttcagactcctcatagctctagagggaactcagcagcacaggggtattggcccatccctttctcttctcaccacaactccctcccacactgtgagggttcctgcagacacaagtgtgaacatcccagcccactcctagacttgggcaagacttaggcccttattatctgccaatgaccaccctctcccttccactctatcaagaagttcacagtgccaaaggaatgttcccacctggagccagtgcccttatctatagaccatgctttggtaactgggctcatggaatggtctatctaatggccgtgaacctacctccggggcctgtgtgggcctcctcctagtttcatcctcccaactgtatgcccccaacccctagcatagccaaaatgtagttgtttgcaagaatgtagacagaatgaggacaaacaggctggtatgttctcatttgtggataatgataataaagattactaaaaaaggagacataaagctcggttcaaaatgacagaggtgggaactctagggctctattcatccacaaaagcaataag

SEQ ID NO: 413283 - DNA, 159 bp, Homo sapiens
tacacatctttattacacatttgtcaatacatatcagtagataccatcatttttgtagtctcgttttggtatttccttacctttacaaaaacattccaggacttcaaaaacagtggggtgtcccaggccccgatggacttgagagtgcctccttcaagt

SEQ ID NO: 413284 - DNA, 452 bp, Homo sapiens
gagatcttaagggagtcgggtagacgttgatgcaggagtgaggtgagtgagctgtatttgacatgcactccagcctgggccatagagtgagactcagtctcaaaaacaaacaaacaaaaaaagaaaaatgaaagattaaaaatgggaccccaggatgtggctggatgggtctgtggctggggtagtgcggtgaagggagaatgctatggcaggctacacacagggcaaagaccaaggaggcattggttgatgcctctgatacatcccctaagggggttaaggagagtgaacaatggattttcaaacctggaagactagcagagtcccaatcatcttcatacaaaaacttgaggactactggactagcctggagccttagactttccaggccacacacatgtttaccatacacagtggccccaattgtggccagagagtgtggccactgtgtt

SEQ ID NO: 413285 - DNA, 441 bp, Homo sapiens
aatggtgagttggagaagaggcttgttggaggctttctagatagtaaagctaatagattgtgggactgtttgggaataaggaagagagatgttagcgacatctagcgcatacccttctttctccgtgtgggcacatgggaggcttacacttctctgctccctttgtaggtagatgagtccatgtgactagttctggccagtatatttgagcataaatgaagtgtcacttctaggctgatgcatataattgtcattggaagaccttccagtattgtcttcctcttgaatgataatggagaaggctaaatgttaacactccacacagcacgcttgtgtcttccatttctttcatttgttgtcctagcgtcctgtgtctttaaccctccatcaccttccctctcccacagatgtgctaagtcattgctattgggcgtacgggga

SEQ ID NO: 413286 - DNA, 445 bp, Homo sapiens
agcacagcctccaatgtagccacgaggcttgtgctgggccctttcatgatttagagcatagaacctgaggggtttgtgcccatcactgccccggtgccaactgcaggagacggtgttctgatcaatggcgtgaagctggacaaaccggtgtgggacttcccccgatgaagactctctgtgttctcctgtcattggaatttacagggcctctaagtgaatggcccctggagaatagtcctagaattttgcaagtcatgagcttagatataaaatctgagtgtgtctcccatctcctgcaaccccctccctaaacataaggaggtcgtagagcaaagcaaataagtgttttcagagccggctgggtgctggggacctgtttagctcagcgataggacagaactttggaaagtgtagcattgggcatttgttcctcactccttagatt

SEQ ID NO: 413287 - DNA, 104 bp, Homo sapiens
cagagttctccggaagagaggaaccaggaatgggaactccaacaatgagaagggcaagagacagaccgtccttttcctgcaataataacttctcacatttatta

SEQ ID NO: 413288 - DNA, 113 bp, Homo sapiens
tcccagcccagctatcctgcaggttccagccccacagcacgtgtgtctctgtgtcctctagccagtaggcttctcccccagaatgctggatttcttatggagattttcctgga

SEQ ID NO: 413289 - DNA, 461 bp, Homo sapiens
cagtcacgaagtaagtcttactgattccatttgttgttagttctgacacaggaagaccaggtgcctctatttgttgccctctagtggcaatctagggagtgggtgggccgccaagaaaagcagctgttttaagcttttgagccacatgaggcatggctcatgaggcatgatggctaggtgaggtttggccatttctggatttggaggccacttggagagtcaaggacattgagcacttaactgacttaacagtttatctccttcttctctaccttgtctgttcccatcgctgtccttccaggaatgaaaggggtttgtttaattccaagctccatctatagacttcagcacattaaatcttatctcttcattctcagccaagccctacaccataccctgaacatcactaaaccataggagagaccaagagagaattcaaacacagcccacctcctctactg

SEQ ID NO: 413290 - DNA, 446 bp, Homo sapiens
agcccctactctgtctacaactttaataaatcaaactcatcctactattgaatcaagttccttttgcttcaggtggcagaaaacgtatggagcaactcaaaaaggtgttgcatttgtaatctaaaatgagccagcaaccccctggtgccactctatgatgcagagcttttgagacagtataactgttgagatgtgttacttccactcatttgtccttacccccaaacacaggcatcctggcaggacaaatgaaagttgtttgcagcaaactgaaagagtaacagccaatatcagcgtcatccctattgggcaattgctacattggagcctgatacatgaaaaatgcaatggatgcactttaggctcaagatgagagaaggaaatggcttgagaccccactatgaggtggcacactatgtttaacagctccagaccctctcatcata

SEQ ID NO: 413291 - DNA, 500 bp, Homo sapiens
aagtaattttcagcatttgtatagttcaacaacaaatgagatacttgtattacttaaatttatttgttttcttatttattatatttccctgcactagaatataagccctatgacagaagaaatcttgcctctaattttccatcaccagtggccagctcaactcctcacaaaagacaccatcatacattcagtttttttgttatcttttatttccttcaccctctacatccaatccattaacaagatttttaatttccttcaccctctacatccaatccattaacaagatcagtagcttctagctacaatatctatcccagtccatcaacttttctccatctctacgactatcacccttgcccaagccactaccaaccacttctacccaaacatgttggctcacgggttccactcctgttttctttaatatattctctagacggaaaccagagtttctaatttttttttttttttttgaggtggagtcttgctctgtcgcc

SEQ ID NO: 413292 - DNA, 330 bp, Homo sapiens
caacatattttcctgattagagagcttccaatcaaatttgcatttatatttagaagtttggaagtttatctgaaataatttctgtacattttttagattctgccttaccaattattctctatttctaatcaaacacttgcttataaaatgctcccgatgaggcaggtggtatctgaaagttccttccaaacctgtaagtctaaggcactttagaatgagtattcaagagcaggtatcaccccaacagtcacacaaaaatgccggcatttcttatgtataagaatggcataggtaaaacggtttgggccaattccaaagtgctagctgcga

SEQ ID NO: 413293 - DNA, 223 bp, Homo sapiens
taatattcacgggggggtgggggaagggaattggatcctatctttgtgttgttagctggttattatgcagactttattatgtggttgttttatagtgtccataacctatgtacttaagtttgtttttgtggtggctggtaatggtctttgctttccatgtttagaactccctcaagtacgttttgtaaggcaggtctggttgtaacaggttcccttaatattt

SEQ ID NO: 413294 - DNA, 392 bp, Homo sapiens
tgtttgttgcctcctccaacctggaaggaatcccccaagcttagctttttcttcattctgagaaggtaccgaatttgccccttcacttaaattctttagcagcatcaacaaaatagcaccaagtattttggagatcgaaagttgattcaggctaggagttacagtctaagcacaggtgcacttaaatctaactaatctaactatggatccttcagaaacaaataaacctgaaccctgtccccacatgtaacctgagattattagactagagatcctggagacaccttcaggctagaatcatccaagattctgagatgcctgaaatacttgcattgaaaaaacttaaacaaaaggttgtttctgtatttagccactccaatttatttgccatt

SEQ ID NO: 413295 - DNA, 393 bp, Homo sapiens
ccagctctcaatcattttgaatcccctggaggcatttgctgcaagactgagcttctggtcactcccagttaagggtgctgtgcatttctggggtcccagttatcagcagcagtgattccactctgtctacctgccccttccttctctgttgatgagggttcttcattcactgtctccccatttctcgcttggggctggcactgcagaaatgcaatggagatggagcagtcagggcccccgtgcccaagaacgtccaaactggtggcagggacagtgtggggcaattgtcagagagtgagataacacacaccacaaacccaatcacaataatatagctaagtatagatgacatataatccagccatcccatgactgagtattcatcacaaggga

SEQ ID NO: 413296 - DNA, 181 bp, Homo sapiens
ggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgg

SEQ ID NO: 413297 - DNA, 360 bp, Homo sapiens
tttggtaatgggtctgtagatacaatatcgaaagcatgaacaacacaagaaaaaattagacgaattggattttagcaaaatcaaaaacttttaagtgtcaaagacattattaagaaagtgaaaggacaacatataaaacaagagaaaatgtttgcaaattatgtatatgataaggatctagtccatgaataaataaaacctcctacaactcaacaataaaaggaaagcaacccaagtactggaatagacgttttctcaaggaagataaaaaggtaggcatagaaaaagatgctttacattatttgctatcagagaaatgcaaattaaaaccacagtgagataccatttcacacccactgg

SEQ ID NO: 413298 - DNA, 162 bp, Homo sapiens
ggtcagggttatagtgcagttgggtaggatgatacgctttgaaaagaacccgggtgatgcccatttcttcctccttaggaacacatctataggttggtaatcaccagcctgtatgtactattgattcccaatacatctatcccttcctgagcttgtttctgt

SEQ ID NO: 413299 - DNA, 162 bp, Homo sapiens
tgatcctcccacctcggcctcccaaagtgctgggattacaggtgtgagccactgcacccagcctgtgctgcacttctctatgcatatgtctcaccgtctggatggcaaattcctggacttctgggcttccagaattctgatgcaccccacagctgacactgg

SEQ ID NO: 413300 - DNA, 389 bp, Homo sapiens
acttgtgatccacccacctcagcctcccgaagtgctgggattacaggcatgaaccactgcacccagccaatattttctttaaaacaatatttaaaatcaatattcttttctttatatgcaacagctataacctaatataaagttacaattttatttcattagcacagttagccattacctagtatcctgcaatagccttcaaaagtatattaattgtattacattaagaataaattataggatgaagaaacaataaaccaatttgccaatcactcacaagaaatgggtagggttcaaatcatcagttacaaaaagaatatttagcaggagtcactttctatgtccttacattacacagagatgtggtgggatatgagggcttcaatata

SEQ ID NO: 413301 - DNA, 362 bp, Homo sapiens
caggagacaagcaacacagtagaaaaatgggcaaaagacattaacaggcaattgacaaatttggggacacaaacagaatggccaataaaccactagtaattgtgaaatgcaaattaaacccccaacaagatataatttcacttctattagatcagcaagagttagagcctgaaactatcaggtgttgaagacatggagcttccagagtactcatttggtgctgagggagcatgtatctgggaaaggcagagatgcacacagcttgtacctgtagtctctaggcatacatcttggtgagattctgcccacacacaagggaccaggcacagaaatacttatggcagtactgtttgtgatagtaa

SEQ ID NO: 413302 - DNA, 373 bp, Homo sapiens
aacaagaaagttgatttcacaaagatgattcattaagaaataaaatattcatggctgacagcttgaaggatcgccatacagttatattctaatgcacctgtcctctctgacaagtccaatgtgggatgtcatgtcgccaaagttttatttagaaattgtttgtcagagtgagctttctaatgtgaatgaaaaattcatcccctcattaagaagattttacatgaaatgtctaggattttcaatgaacaccaggacatgaaccaattactgttaaacacttaaagagacagagtcctaagctcactcagcaaaactcttaattgcacaaatgtggagaaaattcaacatcccgaaaggcaaatgggaattttga

SEQ ID NO: 413303 - DNA, 119 bp, Homo sapiens
agttcgttcttaaccggggtttctcggtgggtttctgcttctcctctcctttcccattccgtgacggttgctccatgtggcccggcatccttacaggagatggtcctgtcttcatctct

SEQ ID NO: 413304 - DNA, 342 bp, Homo sapiens
gccccatccatcaagccaggcaaaattggggttccaggcaacaaaaaccatcaatctagactgtacatgagttcccgcctagatctctacaaccacatgacagcaaataatctcagcagtaaacgtttggtgtgacacaacaggcattaagtgaacaatatttatgatctccaatatttttcacattatagcccacataaaaaatgctaatatctgtactgcacactgggatagaagagcaggttgctcgcagtggagggacccagctcccaaagggctgcagggaccaacaccacagcacgcaagtagccagtgattcctagagcccacctaggacctgcg

SEQ ID NO: 413305 - DNA, 284 bp, Homo sapiens
tgccacactgcaccactgcatttaaatctcagctccaaaagtgggctagagcctacaactgtgttctcaaacaaaagacgccccaggttatgaagtcagaaaactcccatcacttccccggctggaacatgacaaaggaaataagccccaggtaaagcactccccaggtggaagataggcgggacagcaaagaaacaaatccaaagttgagatgcaatgcctgtcttgttgaaggcatcaggcatcaggcttccctgattgctactcatgacaaattctacacc

SEQ ID NO: 413306 - DNA, 234 bp, Homo sapiens
cccatgtctgtatattaaaatttgaagatagtttttctgcagagaacatttaagacacctagatggcaatttaaattttttcttcagtacagtctggaaaccctataattgtgttaaatatattttttcccatatggggtctcactatattgtccaggctggactcaaactcctgagctcaagcaatcctcccaccttggtctccagagcatctggactataagtgcgtcttac

SEQ ID NO: 413307 - DNA, 621 bp, Homo sapiens
cagcctgggtaacatagcgagatctcatctgtaattcttattaaagaaaaaagaaaaaagtatctatccatgtatatatgtacaaatatttgtatacctgtctctctatactgatagaatgtggttccttaaaagggggaattattatttataacaatatgcacaccactgaaagatctttaaatcattcttttaaaagctaattgtagagtacagtgaaatagtgggaaatatgtagttcaatgcaaatttattcatttgcaaatccgtagctcaattttacaaaggatgtaagaggaaaaactattgtttatctaatgtgtcctttttaagagtgctgtggtgctacctgattgtttcgtgtctaagacttgactgtcataatcccactgtaatagacgatgtgcctacctgtggttgacacacattcttggcattagtaaaaatgaaattggtctcaaaagagtgaatctaaatggacagagactgactctcactatcagtgataccatttaatacctgtgagtacagactgagactacaagaattaactaaaccttcagactaattttgagataaaatgtattttttgagtacataaattgtcatttttcaaatgat

SEQ ID NO: 413308 - DNA, 363 bp, Homo sapiens
agagcacatgaaaaggggaaccccatcctcatcccagcatcccaagctaaggggaccctgagggagctgaacatttggctttcgatgctgtcactgaggacccagggagatggcacggaacagctcagtgccgccaggctggccttcagcccacagcctgcttgccagtcctggaaggacagtaaggggacggctcccgagcctcagcccatacacagtgctgcaccctgtagagaggaaagtcagggctaggttgagacttgcaaacattgcctctttgtggaaatcggggctgattttgccatgagtcagggtttccatcctcagtcgacgccagcctcctccggacccccctttgagcag

SEQ ID NO: 413309 - DNA, 249 bp, Homo sapiens
ccttcctccctgttctcctggtctcatgccatctgagccttctctcgtcctcctctcaaacacaaggcaggctcctaagggcctgtgccctcagctgtcttcttccaggatgtttatgagggcccctccttccagccgccctgtatctcctttccaggggtgctgccatcaataaatacatcagctcaaacacttgtccacaaacacctgtccaccttttttttttttttttttttgaggcacgatctt

SEQ ID NO: 413310 - DNA, 163 bp, Homo sapiens
gggtcatctagaggatcccgatagagcatacccctccgccatatgcagctgtgaaatctgccctgcctcccttcccctactctttaaagacacacctgaaaaaacaggtgtcagctacaaaaccaaatttccctgacttccacgcggccattcctagggcttt

SEQ ID NO: 413311 - DNA, 267 bp, Homo sapiens
tcaggtgatccatccacctcaccctcccaaggtgctaggattacaggcatgagccaccatgcctggcctgatttttaaatgtttttgtagagacagggtcttgctgtgttgcccagtctggtcttgaactcttggcttcaagggatcctcctgcctcggccttccaaagtgctgggattacaggcatgagctactacacttggccaatcattgctataaaagaaagagttacaaggagcccactagtggtgggggttgccttgttgg

SEQ ID NO: 413312 - DNA, 478 bp, Homo sapiens
ttaagaggcatccctttccaacatccctaaaaataaatataactattttggatataggagagagtgggcattcccagcctgggttggggagcacagggagtgtgtggtgtggcagttcagggcaggtgccaactgttccccatggagacccgctggggaggagagtccatctacctgtcagcctgaccaagtccgctcaccaggcctcacttcctcccctggatgtgggaggtaacatcctagaccagccccaatcatcaggtgggatggaaggtctgacggaggcagacgctgggcctggcatagtgcaggaccccaagacatcaataccaacctgcctgcgaggagaacttcatgggtggattaattcattttagaaagttttttaagtttatactctgtccaggcagtaggtgagggcaaatggacaacctgtccttgctgtgtaattacaaggcctcatccaaatacatcagaa

SEQ ID NO: 413313 - DNA, 394 bp, Homo sapiens
cgcgcggtatatcgccacagctcacagagtctcctggtcccagactcactgggagtgacgcaggtgggagaagctgaaggcctaacgtggctgttttatttgtttaaatgtacagggctcagaaatagaggattttggaaactgtattccactgttctaaaagagaaagtgtgtaggggggaaaatagcatcttgactacaatgtaatcctagatcttgaaacgtgaggttacatggacaaaaaatgcttaatcccaacttgaaagtatgcataatattcaaaattatcccccaccttcagtgctttacccaggttatggagattcttgaaaaacatgtaaatgaactttgtgtatgttagtctatgtacacatttaggaagagttccatttaa

SEQ ID NO: 413314 - DNA, 179 bp, Homo sapiens
gttttttattatttcaaacctgggtacaatattttcaattaatgccttaactacattattagcagttgcatttgaaaagggaatagcttctacccagtgagtgaggtgatctactattactaataggaattttaggtgacctattgaggtatttctgtgtaatcagtttggacactatg

SEQ ID NO: 413315 - DNA, 508 bp, Homo sapiens
taggggtctcatcactcatcactgggaacctggtcaggggcagtttgtcagtacctggcctgctggccactatgtgacctcaggcaggggggttgtctgtggagcctccttgcctccatctgcagggaaagtgagtcggggcaccctggagggtggctggaaagagaaggtgagaagatgtgttgaatccaatactgcttggcagacctacaactttacaaatgacctgtgttccacctagagagggtgccagccctctcagcattatgcagtgcccctcctctgtctgcatccccaggaccaccatgggtggggagggcagagattggggagcacctatagaggctctaatgctctaaggtgacagtgatgaggacctgggtgcacccatgagtggagaagctaggcctgtccagagaagcaagacaaacacacacatacacacacacacacaggcacacatgcatacacaaatacattgcatacacacatgtcagttcaggggata

SEQ ID NO: 413316 - DNA, 118 bp, Homo sapiens
gaaatttatagcattagatgcataaattagaaaagaggaaaagtctcaaatcaatatctcacctcaagaacctagaaaaaagaagagcaaaataaatctaaagcaagcagaaagaagg

SEQ ID NO: 413317 - DNA, 338 bp, Homo sapiens
caaagcctccatgtgcacaaaccctggttccaccaggctgtgcggccagctgctcgtcctcatcctggctgcattgctgaccttcccctctccggatcacatctccccacaggaggcagagccctggcctctgtgtctctcaaacagtgatctccaaagacagaatttgggtttgttataggagggctgccacctgcagccccctaggccagagcccatgtcactgacaatttccaaggccttgaaagggacctttaatccaactgtctgtgttgagcaggccatgggcagcccctccttcccctccactttcctctcagctctcccttcaaaggcag

SEQ ID NO: 413318 - DNA, 396 bp, Homo sapiens
gggagctcttagttctgaaagtcctccccaggcacagaaggctgaaagcccccaagcacccactaggaagaaaagtgtaaaagttaaaaagttaaaaagttgagataaatgaggtagacatatggcagtttacagtagatggtagaaatgcagtatgattgctggagggaaaaaatcatttgaaaaaaatgctcactcacatatctgatgagagatttgtatccagaatctgaagaactcttacaattcaataataaaaagacaacctaattgaaaaataagaaaaaaaatctgaataaatatttctctgaagaagatatacaaatggctgataagcatatgaaaagatgcttgatatcattagccatcagggaaatgcaaatcaaaatcacagtg

SEQ ID NO: 413319 - DNA, 457 bp, Homo sapiens
gcagttactcaaagcagcccctacagaccattcattcccccaagagttagcagaagcttaagtgggcttggactggaaagcatgccccacaagtcccacaacccccaggtaagtaggcactgacaaaagcgatttcatcaccagattatcaataagcccttcacagatggacatctcactacacccgacccaatgcttgcttagtgcactttttaaatcatattagaaaacaatttacttaattcaataaagcacctggcctattatactgttatatactcaacagaacagtatttcatataagagaagcaacatctcaaaaggcctcatgtatttcaacatataattggcaaccacatataaacagcaggaaaataactcagtatcaagcatggttcttgttttctgtttaaatgttttccttcttcccacattttgtatatagtaaacgaaatga

SEQ ID NO: 413320 - DNA, 536 bp, Homo sapiens
cttctagctcggtaccctttttgattagtattcttaaaaattggaaaatttggaaatttttcttcaaaacccatttctacaaaaaataaagccaaaactatctgggtatagtggtgtgtgcctatattcccagctactcaggaagatgaggtgggaggatctcttgagctcaggagttcaaggctgcagtgagacaagattatgccactgcacagagaccctatctcaaaaaacaaaaacaaacaaacaaacaaaacacaccaaacaacaacacaaacccagaaaagactgaaagcttttcctctaatatgaggaaaaagacaatgatgcccacttttactaattctattcaatgtagtactggaagttctagccagagcaattggacaagaaaaagaaataaaagccatccaaacttgtaaagatgtataattatctctgttcccagatgacatatgtgaaaatccctaaagattccaccaaaaaaacctgttagagataataaacaaattcaccaaggttgcaaatataaaatc

SEQ ID NO: 413321 - DNA, 107 bp, Homo sapiens
tggctgagggccaccagaaagtggagcgggccttggttctgacatgggcttagcatggtaggctaggtaaagtcagctctgtggaggtgggcacagtttgtcatgtg

SEQ ID NO: 413322 - DNA, 308 bp, Homo sapiens
tcacacaccctgagctaaaccttctccatggtttctccatcctgcttagacatataatagaaaataaattacaaaaataatcaccaattttcattgagctcttgccatggtgacaggtgctatttttgagttttacattcatttcttcatttaatcctcaaatccaccctttgaagtcactacccaggacccaaacagatgaggaaactgaggcttaatcacacagctggaagggacaaaaccacccctattggccccaaagcccatactctttgttccccagcaagctgcgcacttaggaaggaaat

SEQ ID NO: 413323 - DNA, 557 bp, Homo sapiens
tcttcaaatgatttgccaggtaagcactgatacaaatttagtttttacatgatgcattatttttactgtttccttgcctctacgtcattaccatgcccacaatatatcttcaagtcatccatgtaaattggaaagttaaaaaccagtcactgccaactgactatgtgccacagaaaacttacaactactcgagttacaaatgcaaatgttttgttcatctacctggttatatataagttcattattacttagcataaccatttgcaggtaccaaatatacccacaatgtatatataagaacatcctatcaaatcactggctgatgtatgagtaaaaaaaaacagaataagatttaaatcagaatcttctaaaagcatggcttttggggtctaattgaaggataagaagagcaaagtcaaatataaccagttaaaagacagaatgaaacactccatttattacagagacaaaaaaagataaagtactcaggagtgaacctaatcaaaatggtataaaatctaaacaaggaaaattttaaaacactcctaaagagcaca

SEQ ID NO: 413324 - DNA, 251 bp, Homo sapiens
cacacatgagcaagaatctctcaaggatatatgccacgttgaagggtattatgtgtatttaactttgaaaaataatgccaaaccaggcgtggtggctcatgcctgtaatcccagcactttgggaggtcgaggcaggcggattacaaggtcaagagatcgagaccatcctggccaacatggtgaaaccccatctctactaaaaatacaaaaatttgctgggtgtggtggcaggtgcctgtaatcccagttac

SEQ ID NO: 413325 - DNA, 216 bp, Homo sapiens
ttgaatttcattgtttcttactcttctgcaaaagggcaggagtggtggcggggttttgtaggaatggttttttacttatggactacaagaagcaaagctgggccgggcgcagtggctcatgcctataatcccagcactttgggaggccgaggcgggcggatcacgaggccaggagattgagaccaacctggctaacagtgaaaccctatctctact

SEQ ID NO: 413326 - DNA, 400 bp, Homo sapiens
gtagctgggactacaggtgcatgccaccatgcttggctaattttttgtatttttagtagagacagggtttcaccatgttagccaagatggtctccatctcctgactttgtgatctacctgccttggcctccggaagtactgggattacgggtgtgagccaccgcgcccggcctatgttcaagttttaataccactaatctgttcagtctgttagagcttgagtattacttttccaaaaggttttggctggcactagaaatctacttttactactgttacatacagctttccaggaaaatcaacatttttttaaactcatttttcagataaaggatatagaaaagaaacaaaatactttccttatttaagtctgttgtctaggttaggcagcatgtgtttg

SEQ ID NO: 413327 - DNA, 532 bp, Homo sapiens
tggcttctttcacttagcataattccttccaggttcatccatgttgtcacaaatgacaggatttccttctttcataaggctcaatagtattccacagtatatataaatatattttctattttttctttttttatcatttcaactttcattttagattcaggggtacatgtgcaggtttgttaatgggtatatagcatgatgctaaggtttgaggtacaaatcccatcactaggtggtgacacagtacccaataggtagtttttcaacccacactccactccttctctccccactgagtagtccacagtgtctactattcccacctttatgtccatgtgtacttaacatttagcttccacttataagtgagaatatgcagtatttggtttcctgttcctgtgttaatttgcttaggaatatggcctccagctgcatccatgctgctgcaaagatcatgatttcattcatttttatggctgtacagtggtccatggtgtacatgtaccaccttttctttatccaatccaccact

SEQ ID NO: 413328 - DNA, 122 bp, Homo sapiens
ctcatccagccttcacagggcagcaggtggccaccatctcctcggctgaaaatgcccttggaatgaaatgtacacctcttcagtgcccccaacccctccctccctcaccgctcccatctaag

SEQ ID NO: 413329 - DNA, 219 bp, Homo sapiens
aacaaatgtgcccaaacaactgaatttctacatgcatgaatttctacatacatgaatgaagttggggccacgtgtggtggctaacgcctgtaatcctagcactttgggaggccaaggcaggcagatcacttgaggtcaggagtttgagaccagccgggccaacagggcaaaaccccatctctactaaaaatacaaaaaaattagccaggcatgatggcg

SEQ ID NO: 413330 - DNA, 680 bp, Homo sapiens
aaaagagtggaaggaggtgagcgcagcgaggaccgaggcgaaggagggtcagtgcggaaacccggtgtgaggggccgagtgaggaaggttcctgcagggcggcgaccgggttttaggaggtcgcggccctgcctttaccggagggcgagtccccgccaagcccgggctttggagatggaccgaagaggggagggaggactaggtacagaaataaaccgcggagcaagaagcacacagtgccgaagacagaaagccggaggagaagtcgaaaccgcctcctcagcctctgcgggagcgtggtaggggaagagtcacagactgaccctgcgtctcccgccgggaaccaactgcagtggtacaccccacggaaagctacgtctccttaccgactgcgcacgcccccaacagactacaactcccagaagcccccgcccgcgttccggcgactgcgtggcagcacgggccgcttccttatccgagaaattaacaacataaagaagaaaatgtttgcgaagaagattttatgtgatcaatcaacaaagacatgaagcatggagattttgagaaaggtcaggaaactatagagaaagacaggttattggggaagctggtggtgtaaggttacatgagtaagttctttagttggtgatttgtgagatttcattgcaaccattgcccag

SEQ ID NO: 413331 - DNA, 712 bp, Homo sapiens
agcgggagagccgaccggggccgcggcaaagagctggctgtaatcccgcctcccgccagccatggcccacttgcgctcgcctagcggcttcggagacccggggaagaaggaccagaaggagtcagaggaggagttagaggaggaggaggaggaggaagaggtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaacccccta

SEQ ID NO: 413332 - DNA, 1016 bp, Homo sapiens
agcgggagagccgaccggggccgcggcaaagagctggctgtaatcccgcctcccgccagccatggcccacttgcgctcgcctagcggcttcggagacccggggaagaaggaccagaaggagtcagaggaggagttagaggaggaggaggaggaggaagaggtggcggaggaggcgccacaggcggcggaggcggcgccccaggtggcggaggaggaggaggaggtggtggaggaggagttggtgggggaagagcaggagttggaggcccctgagacgttcagcgaagagtacctctggaaggtcacggacatcggtgactacgacgacgacttcccagacgtgcgcccccgcttagccagcatcgtcagccctagcctgacctctacgttcgtgcccagccagagcgcgaccagcactgaaacgccgagcgcaagcccaccctccagcacctcctcgcataaaagtttccctaaaatatttcagacatttaggaaagacatgtctgaaatgagtatagatagaaatattcatcgcaatttgtctccaggaattccagtatcagtacaaacagaagaaagttggctccaagatttgtctgataaagtgcaatcgaggaagaaagcctctaaagagaaagctgaacctgaatgtctggcatctaagttaagagaaaaatgggtaattaatccagaagagtcgaaactaaatattttatatgagctggagtttaaggaagacttcataacactgttcgagccttctctaagaacgttacccagcatcggaccaccatccattctggcatacaaagaagagagctccaatttaggcattaacttcaaggatgaagaggaggagacatcacccaaatgtgaattttgtggcagcgatctaagagcatttttttctaatgtggatgtttcctctgaaccaaaagggcatgcctcctgttgtattgctttccaaaatctgattgactatatctatgaggagcaaataaaaaccaaacccccta

SEQ ID NO: 413333 - DNA, 820 bp, Homo sapiens
tgtcggcagggctgctccctcagaagcaccagggaggatccttcctgcctcttccagctcccaggggctccaggggttccttggctggtgacggcaccatgccatcctctgccttctgtgcacacagccttctcctcgactctctcttccattgataaaagggtcttgctctaccacccaggctggagtgcagtggtgtgatctcagctcgctgcaacctccacctcctgggctcacacaatccttccacctcagcatctggagtagctgggactacagtcagtcctctgggctccatctataaaacaaatgtttgtcatcctccgggaaacagagcacatctaacagaggcaggcaattcctggagcttcttgattctgttcagcagaaccagggccccagcggcagaggcctcccaggaggtccacattgtgcaagacacgaactcaggtcctttcatctcatccatcaacagcccagaacagagttaattttgcccactgtacaaagggtgaaacccaaattcagagaaattgactggcctgcccgtgcctgcccagctgggaggagtcagagctggcttccattcacacgtgtctcactgagaacaccaacccacaccctgactgaagggctggtccaagcctacttattgggtgtttgctcactaccctccttctccctgtccacccttcccttcgtggacagaagccagagttcagagaggatccccaggtccccagggacacacagccaggcaaggagggagctcacctcaactgctgccttctgtccagggcctctccaccccaaccccaca

SEQ ID NO: 413334 - DNA, 510 bp, Homo sapiens
tggggcgttgctagccctccttagagagggcgagggagaggaggatgctgtgcctggaaagcggctcttgaggagagctggaatctcggcaaagcgtccactccctcccctcccctttcctctcacctctagtgttcccaccagccccggggaggagacaaaggacgtgggagggcagcagcatgcagggggcctgcctttgacgcccaggagttgaacaccagacagaaaatgaaatctaaacatttacccagagccctgggctagaaatgggccaacctgaccctggaaaacaaacaacccgcgtcaccgccacacctgctgcaggccccagatgccacagatgaggttttgctctgttgcccaggctggtctcaaactcctgcacaagcaatctgcctgccctggccttccaaaagtcctaagatttcaggtgtgactcaccgcgcccagcctcaggttgccttaaagaaaagtttctgtatattaaatataaactatatgatgcac

SEQ ID NO: 413335 - DNA, 917 bp, Homo sapiens
agcggttgacaaaggcagactccaccaagataagaacctgaccacctccaagatatgtgctcatctgtccccactgcaccccctccagaggcaacttttcattgcagatcagcgtgacctgttctagagcttcctacaggcagagtcaggccacactggcccgccccagctctcagaggcctgccatcactgtgcacccacacaccaccagctgtaacccaggcacaggacctcaaggtgggccagctcagctgccaacaggagcgagtggtgctgaggtatccagcagggcagcacatggtcctcccaggagccgtggcccagcacctcctggccggaacagccatcctattcaaataaacgagtaacaaaaatgggcacgctctccacttccaaaagcaatgctggccaggcacagtggctcacgcctgaaatcccaatgccagaggcgttggaaccagagcaactccatcttgaacaggagctgggtaaaatgaggctgagacctgccgggctgcattcccaggagtttaggcattctaagtcacaggatgagataggaggtcggcacaagatacaggtcatgaagaccttgctgataaagcaggttgcagtaaagaagccggccaaagcccaccaaaaccaaggcggccacgagagtgacctctgattgtcctcacggctcattatatgccaattagaatgcatttgctgctaaaagacacccccaccagcaccatgacagtttacagatgccatggcaatgtctggaggttaccttataaggtctcaaaagggcggggaggagacctcagttcctcttcatccctttactttcctgataaacttgctctcactttactctgtgaactcgctccaaattctttctcgcatgagatcaaagagacctctcttgg

SEQ ID NO: 413336 - DNA, 864 bp, Homo sapiens
aacatgaactctgcccggaggcgacgggctgcggcggagggggagagagaggaggacaggctgcgaccccgggctggggacgccagggcagggacagcgagcatcaggaaggagagcgtccggggaactcgagtggccgcgccctgggtcctgcaccgtgaggctggggggaccaggaccggcgggcgcccaccttggtcctgagcccagctgccgacgctgggccagcaccctctccaccgccgccctccagtgagcagagctgggctcaggcagcagcccctgggcgcgggaaggtagcgggagctgcatttaggggaggggggaggtagcaggagctccgccagtgggaaccttggagtgaattcgtcggcgggtgccaagtcgaagcgccgacctcctgtctctggactggggcccggacccctgcgtccccaaactgcgtccccgccttgctcgtcgcccggtgccttccttaggcgcagcagaccctcggtaaacagcggttaattcgatggaatcggatcacagggccctcggtgaagcagaaaggcggaggaaatccaggaggcagaagtgaggaccctggcgcctggcgccgctgcgttgttcgtataagaagaggcatcccggaaggggcttcaaaccacttaggaccgactgctgaaacgaatccaagcttgtggtgtctgcagaatttaactgtccgcctcaaccccagtttttgtttctaagattatcgaaaactgtgcggtttgagtgatgtgctacaaagtgtttaaaacagattgtttcccaaattaggggtttccacacaagaaatcgctgctgtcggcaaacacaggaactatctatggttaagac

SEQ ID NO: 413337 - DNA, 584 bp, Homo sapiens
aaatgcttaactccttgtatttatcaattccgtattcatcaaaagtatatctgttagacaataacaagtgttgatgaggatgtggagaaatcagaatccttttagtactgctggtggggaggtaaaacagtgcagctaccttggaaaagagtttggcaggtcctcaatcttcttcattagtccaaaacttggaaccaacccacatacccatcacctatataagaaacacacaatgaaggccgggtgtgatggctgatgcctgtaatcccagcactttggaaggccaatgagggcggactgcttgagcccaggagttcaagacctgggcaacatagcaaaatcctgtctctacaaaaattagtcaggcatggtgttgtgaacctgtggtcccagctactcgggaggctgaggtgggaggataacctgagcctagggaggtcaaggcttcagtgagccgtgatcatgccactgtactccagcctgggaaatggagtaagaccctgtctcaaaaataataataataaaataaaaaagaaacacataaaccaaacgtagtatatccacaatggagtattattcagaaa

SEQ ID NO: 413338 - DNA, 665 bp, Homo sapiens
aggcttaagtagaacattttgagtaagaactcagccacagaaaacaaacgaacaaatagaactagtggtttgagtttgagttctttgaagttggggcagaagtgactggaagtagagggatcagttttttgttttttttttcctcctacatctacgcttgagcctttggtgcacaggtggtagtttctatttggaaaaatcacctcttaaaatttaccatataacatagggagttttgctcttgttgcccaggctgaagtgcaatggtgtgatctcgactcactgcagtctccgcctcccgagttcaagcaattatcttgcctcagcctcccgagtgactgggattacaggttaccaagtggtgctgatgcagctggaccagggcccatgccttgaagatcactggcttaagaccagggcttttaaatagtacccagaagagtgattctcagaagataatctgtgaacaatgtttatcagaatcatctgtattgctcattaatttaattcttgggtcccaccccagactccgtgaatcttgatatctgggtttggaggtttaagaataagcattttggacagcctcactaggcaattcttaatagcatataaagtttgagaaccactcaaattgtgatgtgaattttaattagttttgagaggac

SEQ ID NO: 413339 - DNA, 540 bp, Homo sapiens
gtcacccaggctggagtgcagtggtgtgatctcagctcactgcaacttccgcctcctgggttcaagtaattcttgtgtctcagcctcctgagtagctgggctcacaggtgtgtgccactgcacctggccaatttttgtatttttagcagagatggggcttcaccacgttggccaggctgctcttgaactcctgacctcaattgatctgctcgcctcagcctcccaaagtgctgggattacaggggcaagccaccgagcctggccagcagtcaaaggttttaaactaaattaatcaatcatctttaggttcccttgctctcttggtttgctctggaagctactttcttttcctcagacgtttttagattaaagctataaagcccttttaataggatctctgtgacttgtgtgttaaattgcacttcattgcaatttaggaggaaatggaatttggaagataaaagttcaagtcctgactctgccactttgtactggtcaccaaataaataacccactttgagtctcacttttgtttacaaa

SEQ ID NO: 413340 - DNA, 575 bp, Homo sapiens
cgctgtgtcactcagagatgaggcagcagcagtggttgagggttaaggctggattttgaacagttggagggctctcataccctaagtgttaaatccagtgtgaggaagagccacccaccatctggtcaggagtaaaatgaagtgcctctggggaacaaaggcttcagtggaaccattccagcagatatcatattctgaccattagaaatttgattaagggaagtgttaccctatatttcctgctagtctaagaggtctgacttttaacaaccataaaaatctatacagacccatgtctgtaatcccaacactttgggaggctgaggtaggaggcttgcttgaggccagaagtttgagaccaacctgagcgacatagggagaccaccatctctacaaaaaataaaaaaataaaaattaattgagcatggtggcatgtgcctgtactcctagctactcgggaggctgtgaggtgggaggattgcttgagcccaggagttcaaggctgcagtgagctatgatcacaccactgtactccagtgcactccaacctgtgtgacagaggagaccttgtctct

SEQ ID NO: 413341 - DNA, 500 bp, Homo sapiens
accaaggggtcaaagcaaacagggccaacatcaggacagacctgcatgacgtgccctgcaatgagataacttagaaggacacagcagaactgcagtgggattccctcctgccaccgacgtggagctcgaaccccaccttgagaaacgaccagaggaactcaactgaggcacctcttacaaagcagctgacctgtccccagaaatgtcaaggtcaagaaacaaaaaggaagactaaggaactgttccagatcaaaagagattaaaagatgtgacaatggaatgcaatgcataaacctggactgaacttggactggatccacaactgggaaaaaaatgggtatcaccaacattattgggataattgatgaaattagaatgtgggctgtgggttagatcgtattattatattaatgttacattttctgattttgatcactgaactgtggttatataagacacagtcgtcttagaaaataaacattaaaatatttagatatata

SEQ ID NO: 413342 - DNA, 325 bp, Homo sapiens
ctctataattctacttatgtaaaactctaggatatacaaactagtgtttgacaaactgatagtgaaagaaatcagatgagtggtgactgtgggatggagtaggcgaagggtagatgggaaaggcagagattaaaaagggactagaggaaatttttggaagtgatagacatattccttaatttatattccttatttttattgtggtagtttaatgggggtatgctgtggcaaagcttaccaaattatatattttaaatatgggcagttcattgtgtatcatttatacctcaataaagctattaaaaatagaaaagaaactgcattg

SEQ ID NO: 413343 - DNA, 766 bp, Homo sapiens
ggacagggttgaggaatgtatttggacactgcctgggtggtactcctgccctttggccaacgcccccacccatgcactagcactcctgttgcagccagcctgctctcctctgcgctccctcctgccctataccaccttctttccttcttattcttctctcctgacccctttcctacacctctctaaaaacaatcattgttttaaaatgtacatacccaatacatgggtttgcaaaaactcataaaaacataatgcaaaagaaaagaaaatgaaaagctaaatcccgctctacctcccatcctgtaaatcctgctgtcagtaattgggggttctcattccttccctgtgttggattctatacatttacaacccccctcaacatagttttaagtgttctttaaacatcttcaaattgggatcacactatatatgaatagtcatataactattcatacctactcttttttctttctttcttttcttttcttttctttttttttttttttttgagacagagtcttgctccatcacccaggctggaggtgcagtggtgcgatcttggctcactgcagcctttgcctccggagttcaagcgattctcctgcctcagcctccccagtagctggaatcctaggcatgcccaccatgcctggctaatttttgtattttttcgtagagacggggtttcaccatgttggccaggctggtctcaaactcctgacctcaaatgatccgcctgcctcggcctctcaaagtactcggatta

SEQ ID NO: 413344 - DNA, 735 bp, Homo sapiens
caaattcaacatttcataacaggtgagaagttgctgttgaagccacactgctgatgaggactcaggcaggtgtcccgagaaatcgcccagtcgtgagaggaaccataagaactttgtaaggtaaatacttttcttaactttttaaaatctgggcaagacacaaggtcaatgtttaaaataattactgttggattttctttataagaagaataacgctaattcacatttttagcccgatttctttaattcatatttggcgatagagctattaccatttattagattttgtatcacattctgtataacatacacaaaatgcgtatacatgtacatatatacgaatctacacacgtttaccactaaatactgaaaagcgttatcgaaagtctttatctgcctagattgccaagtagaaagtgtgaccactttttgaaaaatatgaatacactgaatcattgaaatatcttggtgtcccagagagtagaaccaggatagtctaaagcgtgcaaatattaaattgtgtgaagcattttggttctaaatttcagttaagagagaggctatttcacagttggcctacttcctacaggaaaccacagtgatgttttattaagtaatggaatatagtttgtctcttcatttacctgtaagaaatgtggcagggagagacttgaaactaggacttaaagagtgacaagtaccaggcatgagaaacacagctcccttaaagaaaaa

SEQ ID NO: 413345 - DNA, 828 bp, Homo sapiens
ctggtgagtgtaccctttctgcagaaagtaaactagccttgctgagagatcctttgtctcggtgttgatttctttacaacatcaaattcccgtgcccatcaattttgtggctcgtatggggacactgtttcccctccagtccttggccctctcttgtggggaggcacccagctgccctgttgcggcagccccagggagatagccagggctcacccagtaagaggaatacatctggattctcagcaatgcaggggacaaggagacttttaaaaccgcgggaccaggagacctcgtgcatgagccaaggtcttttagcacaagcaccacccttggaattcccagtacaatcgcatcagcctggagaccacgtcttcataaagggatggaaggaaggaaggctcgagccagcctgggaaggatcctacctcatgttattgaccatcgaaactgcagttcgcactgccgagaaggggtggacccatcacactcgagtcaagaaagcgtcgacaccctcagaatcctggattgtggtccccgagccaagtcccaccaagttaaaattaagaagaacctaacatacctttatttctatttttctttctttcctctcactatctctcattttattattaacataactagattggaatcatctcaagtgatatcctttgatgcttgtctagtgatgccatgcggggacctacataaccaaaggcaactagcctcttcagaaaaatatctatgtcctggtcccccatttaatctaacagtctctcactcccatagatgcgatcaattaaagccaagacgccgcttcttcattcccac

SEQ ID NO: 413346 - DNA, 954 bp, Homo sapiens
cccgggttcaagggattctcttgcctcagcctcccgagtagctcaccatccccacggacagctctcgatgtggccgtgcctgtgtctggcagcctcaccatccccacggacggctcttgatgggccgtgcctgtgtcacgcatctcctttgttaaactgtcatggagattttcagaaaataagtgatttttacattctaccagttgtttatgaaatgtatcttaagaattctacccatcttttgcttaaaacattactgagtttggggtaattaatgtgaattttctataatatcagccaaaaaaattgtgaagggaaatacaggtatcctatgtatgtatatgcaaaatacacagatagaaaaccccataaatacaaaatgcaagtttgggttccaaaaaccaaaagagtctgccaggaaaacgtcagccaagaagatgttctctagcagaatcccagccgttggttcgggcaagggatcagctgctgagattactgggaaggatgttgaagaagggatgtttgcacacaggcccaaggatcatgccacagagaactcgctaattgcaaagggaaagcatgttcccagagtcatctggggtcaccagctgatctgcatgataaaacttagcatccctaattgtgggaccacctgaagtgctgtgtccccagtgtgagtcatctgtgcagtatacctaccaaaaatgtttagtctgatctaaccaagcattcatacctaactttgagtttatgggaagtgtaagagctagaagaacaagctaaatgacagtgagggatactttacaagacagttcttcaagaagccaattttagtttttaaaaaacagtgtgagaaggacatgggaggtgctcaagattagaagagactgaagtggtccctctgggggaaaggaatgtgcccgcgctccccagccaggctccctgacagcccca

SEQ ID NO: 413347 - DNA, 829 bp, Homo sapiens
ctggtacggtccgcgaatcccgttgatctgactgtcttatttcagaaaggcagccatcaagctctgagattctttcctccacttggtctattctgctactaatacttcagctcagcccagttcagaactcctgttggagagatgattcagctgtttgcaggaaaaaaggccctctgactttcaccccaagatgagaccatctagttgcaggaaagcaagctcagggatcccacagattctgcactatggagtggaccagcctttcaacccccaccatcatcagtcattgcctcagagcagtccacaggaaacataaccttgacccaaataaggattgtgaaggaagagagaaatgtggaagagaagaggaagcagaagaaaagaaaaggaatcaagatcttacactacctgaaaagcctaaaatatttacctttatacaaatctttccctttgtagaaaaattttgacaatccctgctctagagagaggaagaaaactccaaggatttaccaggtttctgaaggtaaactactgaggaacaaaaccactaataaaattcctgcaagaataatgtattttttgagtttatcacatggagtttttttcttaaccaaaggataattgagcccacaaataaagacaaaatatccactaaaaatatatcacgtagaaaccattttgaaaattatgaaaagagtatttaactagcctaaatgtaggtagaactatatgtctgataaaaaataaaaagcacacacttaaagcacacaacttgctaagttgttgaaattctcaacacaatcaagattatatattcatatacatatac

SEQ ID NO: 413348 - DNA, 593 bp, Homo sapiens
ataacatctttccggtcaccttgttttctgagctcctgattccatgctggctctctgtgttctacacgacaccaacctggacccatgagtgctctcaaccctggagacggcagaaccaagtctctctacaccctttcccagcaaggggccagggccacagaggaagaatcgcccctgaactctcagaatcctaaagcttcaatggttctggaaatcagaagtcccagaatgaaggtgccatcggtggcgctggttcctcctggaggctctaagggaaactccgtctcctgtgcttccccagcttccagaggtgacctgcattccccagctccttgccccctcttccatcctcagagccacagcttggcatcctccagtctctgtctctgacctcttcttcggtcctcgttcctcctactgcccctcgcataaggacccttgtgattacgctggatccaccagataacccaggatcctccccccatctccagacccttaacttaatcacatccacgaaggaagtccctgctgccttgtaaagtaacatcttcccaggttctggggattcatatgtggacagctttgaggagcca

SEQ ID NO: 413349 - DNA, 835 bp, Homo sapiens
ggcttttgggttatgttcctattaatataaatcatcgtctccatttcagaagaagaaccaaaacacatctgatctgctcttaaaggaaactcaattgtgacaagcagaggaaactaaagaggctggcatgcagtggcatgatctcggctcaccgcaacctctgcctcccaggtgcaactgattatcctgcctcagcctcctgagtagctggattacagggcctggcccatggcaggagctcaggaaatgtcagataaatgattgaatttacaagaacaagcccaacagttaagaaaacttcagctcctgcctcctgcccatgcagcccagaagggccagtttcatgccatgtttgattgccgctccggtcccaggagggatggaatctgctgtctcaccaagacttgggcatgaggctggccttctccagaagctccaggcccagagaaacaatacatctaaccaaagtcccccagggagtcttggcacacagttggtgctcagtggacattggaatgtttcaacagccatgtctccttgttgctgaactgagcaacatccatggacatccatgggacagatggttctctctccagcatggaatcagaaggcctggtttcaagttccaggactgtgcctcattcattgtgtgttgctggctgagtcacttaacctgcctgagcaaagaacagagaagcagtcagatttggaatccactggggaggcagggtttgtaaaacttgttgattaaatgaacaagagtatgtgggaatgagaagaatcaaaatctaagccaagcatctggcctgaacagctgggtggtcagtgaacccat

SEQ ID NO: 413350 - DNA, 6127 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413351 - DNA, 6106 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413352 - DNA, 3256 bp, Homo sapiens
tggggctcaatgcttaatttgttcttagaatatcttggcttgtttttgagaaaatgaagctcacgtgtgtcactgtcactgtcaagggttattaatgacctgtttttttatttttgagatggagtcttgctctgtcattgagcacgctgaattcagctacactgtgaattcactttaactaccagatgttgtatactcagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413353 - DNA, 3066 bp, Homo sapiens
gcgttcagaggaccccttcagcacactttagtcgtgagaagaggactatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413354 - DNA, 6384 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaaaaataaataaaaataaaaaaacaacaaaccaaaacaccaaaaccacacacaacaacacataacaaccaacaaataacatcaatcaacacaaccggccggcccctctaaactatcttaatatatgtctccagcaaatgagtgggagcggcgagacagcacaaatttatatcggggctacaacaccacctgtgtggagatatacggtggtatgtcaaacaaagtggcagcgcgaactcacatctgtaagtgaacgtgtagaaaacttgcttttattcatt

SEQ ID NO: 413355 - DNA, 6081 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaacaaacactgccaggcaagtttgacaagaagtaaccttcctggaatgtttcaaaatgtcgacg

SEQ ID NO: 413356 - DNA, 1619 bp, Homo sapiens
gactcatacaggatccccattggtggtcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413357 - DNA, 930 bp, Homo sapiens
gcggccgcctactactactaaattcgcggccgcgtcgattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413358 - DNA, 410 bp, Homo sapiens
tctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcaggtaggccagtcccaaaaacagactcaagagcatatatatatattagtttgctatctttttctcccaggcacctaagacagtactttgcacccaacacataccacatattattgatttactgatatgttggaagacattttggtttcaattgctaggatataaacatttcaaaacaaaacattctgttgagaaatgctaactctaacctcacctcttcctgccttaagaaaataatttctggccgggtgcagt

SEQ ID NO: 413359 - DNA, 366 bp, Homo sapiens
caatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcaggtggaactgtttaccagggtatcccagccccctgatcttaaaagagttttctcagaaagcagatacagataaggctgctcaagcctctctgggaaagcaaattgatctagttggcttttacatcacataaataaattaaaactgggcatggtagctcaagcctgtaatcccggcactttgggaggccaaggtgggaggatcgcttgagc

SEQ ID NO: 413360 - DNA, 991 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctg

SEQ ID NO: 413361 - DNA, 6209 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgacgaagtcttgctctgtcaccgaggctggagtgcagtgcaacctctgcctcccgggtttaagcaattctcctgcctcagcctcccgagtagctgggactacagatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccattttgaagatgtaactgagtttctggaagaggtcattgaagccttgatattggatgaggaagttagaacatttccagaagtcatgattccagtgtttgatattttattgggccgaataaaagatctagagctctgtcagatccttttgtatgcatatctggatattcttctctatttcactaggcaaaaagatatggcaaaggtttttgtagaatacattcagcccaaggaccctaccaatgggcaaatgtaccagaagaccttgctgggagtaattctgagtatctcctgcttattaaagactccgggtgttgtagaaaatcatggctactttttgaatccatctcgttccagcccccaggagatcaaagtacaggaggccaacatccatcagttcatggctcagttccacgaaaagatctaccagatgctgaagaacttactccagctctctccagaaaccaaacactgtatcttgtcctggcttggaaactgtttgcatgcaaatgcaggccgcaccaagatttgggccaatcagatgccagaaatctttttccaaatgtatgcctcagatgctttctttctgaatctgggtgctgctctcctgaagctatgccagccattttgcaaacccagatcctctcggctcctcacctttaatcccacatactgtgccctcaaggagttgaatgatgaagaacgaaaaattaaaaatgtacacatgagaggtttggacaaagaaacctgtttgatcccagctgtgcaggagccgaagtttccacagaactacaaccttgtaacagagaaccttgctctgacagagtacaccttgtacttgggatttcacaggttgcatgatcagatggtaaaaatcaaccaaaatctgcatcggctgcaggttgcctggcgggatgctcagcaaagttctagccctgctgctgacaatcttcgtgagcagtttgaacgactgatgaccatctatctttctaccaagactgccatgacagagccacaaatgctacaaaactgcctaaacttgcaggtgtccatggctgttctactggttcaactggccataggcaatgagggctcacagccaatagagctaacctttcctttgccagatggctacagctctttggcttatgtgccagaattttttgcagataacctgggtgattttctcatttttctccgccgctttgccgatgacattttggagacatcagcagattccctggagcatgtccttcactttatcaccattttcactggaagcatagaaagaatgaagaatccccacctgagggccaaactagcagaggtgttggaagcagtgatgccccacctggatcagaccccaaatcccttggtatccagtgtgttccaccggaaacgtgtgttctgcaactttcagtatgcaccccaacttgcagaggctctaatcaaggtttttgtggacatcgaatttacaggagacccccatcaatttgaacagaagtttaattaccgccgtcccatgtatcctatcctaagatacatgtgggggacagatacctatcgggagagcattaaggatttggctgactatgcctctaagaatttagaagccatgaatcccccacttttcctccgctttcttaacctgctaatgaatgatgccatcttccttttggatgaagccatacagtatttgagcaagataaagattcagcaaattgagaaggatcgaggtgaatgggatagtctgactccagaagcccgccgagaaaaggaggctggcctacagatgtttggacagctggcacgtttccataacatcatgtccaatgaaacaatcggtacccttgcctttctcacatcagagatcaagtcactctttgtgcatcccttcctggctgagcgcatcatctccatgttgaactacttcctgcaacacctggttggccccaagatgggtgccttaaaagtcaaggacttcagcgaatttgacttcaaaccccagcagcttgtatcagatatctgcactatctacttaaatcttggggatgaggagaatttctgtgccactgtgcccaaggatggacgttcctattccccaactctctttgcacagacagttcgagtcttgaagaaaataaataagcctgggaatatgattatggctttcagcaacttggcagagagaatcaagtctcttgcagacctccaacaacaggaagaggaaacctatgcagatgcctgtgatgagttcctggatcccattatgagcacactgatgtgtgaccctgtggtgctgccatcttccagagtcactgtggatagatccaccattgcaagacatttgctcagtgaccaaacagatccctttaaccgtagtcccctcaccatggaccagatccggccaaacacagaactaaaagaaaaaatccaacggtggcttgcagagaggaaacaacaaaaggagcaacttgaatagatactgtgaactaaccaaaccaaaaccaaccccagagtgcagataaacaattgtttgtggtttctctctttctggttctgttccttttctttcttcttttctttttctttttttttttttttttactaaattagagaactgctcttgctgaaattatgatagttaagattcctaagaacttgacaatgctcccctggcttgcaggaaattatacttattatagcatcaccaagtttagaaatcatcactaattttcacccttctgtcgtctcttcatattcttcttccttttcctaaatgaaattatattatttcaactactaaaacttcccgccaccctgctatttctcttccaattactgttcaaacatttttggtgagtgctgcttttataaatatgtgatgtcacatatttcagtgacagctgatgttatcagaaaaatcctgttatcctgtgtatttactagtcctcatgatctagacttaaccccttttctgtgttacagagtaacttcacataaaagcagatacctttaagtttgtgtagacttctgaataagatgatagacgagaattttttttaaaaaaggaatttaaaggaatcttgtgcaacttctgttgatagctcttaattttgttatacagtctttttaatgaggattggtagggcaatcctaccaattgatgggggtgaggagactgttgggcccttattctcttatgaaaatctgtttctacaaggactaggcctaagtagatttaggcaacgggtatcatatccatgaaaaatgtcattttaagacactaatatcaacagtatatctcagtgtgtgagatatataaatacacatacaccccatgtgcttttttgttggtttagtgtaaactgagtaccactttatattttctcttccatagtgagatgtatgcagtatgtggccatgtttactaacatactcattcttcacaaaattctgagattataaaatgtatatagttaatatttgtttgagcttgtgacctgacttctaagagctacttctaacacagccttaggtcttcaattaacaaagtaggaagttgagcacaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413362 - DNA, 2501 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaaaaccttgtccacagccattttaaatatccacttagccctgtgtagttggtaggtggacaccactttcataagtgaacttgagctcactactcaattgtgcagcttaatatgctgactagggacattcccctatggattatctttatatcactgtctttctaagcccagagatgtcataagtgacaagaaaagtgataggatcaagaaatgggtgtcactgcttcatttggaacatgttattaactatggtctctttcaaataaatagtagttttatatttcaacacaagttgctataagcagtccttgatgggtttttgattgcatcagctggaaagcctcaaatctaagagggcttcccatcctagatataaaataggtgttgcctattgctgtgcttataaaatgaaaaaggaaattgaggacacttttgcaaatgccagaatgtaagattcattcagtgtgctccctgggcctttatggcatgggttgacaggatttgtttattttctaaaattagcttcattcaatatttatcatcctcctttccctctctgagaatgaactatgtataaaataagcttctgcctatttgcatttatcttccaaacccaatctagtaggatgttctcattttaaaaacgaggggaaaagaccagagtttttcaggagaaaactggaggaaaatgggcacaaaaactcagaaggcagctattcccagcagcttcctagttaacaacccccatgctgcctccagtctttgtctgtattcttctgtatttaaccttcagattgtaagccttttctggcaagcttttcttctttttttaaactcttttcctgaaactttttatgaatggctatggcaccattaatgctgctgaatatctttaaactctgcacaagcaagtgtgtagcttaaggccactactggtaaggaaaccaagtgtcctctgtgccttttttctttctgtgaagtaatttaagaatatccaaaaaaattagactttaaaaagttatcttggtacaacaccgtgtgtatatacacttggaagcttaaaaaggtgttttgtctggaacttagaagcagctctaaatctagtagagcagactttctaacatacctagttttgtgtattggctttgctggagtatgatagcaaaatgaagactcttttactcagctctggtattgctcataacttaccaagaggctaatactaaacttggaaaattgtttaagtatgttttatcaagcagtctgggttttgttttttaatatactttttaatggatatgtgaaaactgaaggaaatgttaaaggttttttaatggtgcaagtgaaggtgccagttgctatttgatatcacactctacaaaagcttcattactttatttgatggtggttgctaagcagccattgcacagagcataagtctactgggtgcctttacatgccagaggctgatgctgcactgttgatgtcatgtgaggaaataatgcacatgctctaactgctcaacaggaaatgaacctagaaacagaaaatgaaaaggttgattgaaataaaacttgatcaacgcgactgtattttgaaacattccaggaaggttacttcttgtcaaacttgcctggcagtgtttgttcaaaacttgtatttaataaatgaacatctgacttacaa

SEQ ID NO: 413363 - DNA, 1175 bp, Homo sapiens
acgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatctgatgaactcccagctagcccagatgactcggataatagcgtgtcagagagcctggatgaattcgattactctgtggctgagattagccgctcattccgatcacagcaggaaatatgtgagcaactcaacatcaatcacatgatccaaaggatcttccttattactctggacaacagtgatcccagcttgaaaagcgggaatggcatccctagccgttgtgtgtatttggaagaaatggcagtagagctagaagatcaagactggcttgatatgagcaatgttgagcaggccctcttcgctcgcttattacttcaagatccaggcaaccacttaattaacatgacttcttctacaacgctaaatctctctgctgatcgagatgcaggagagaggcacattttttgttacctttactcctgcttccagagagccaaggaagagattaccaaagttccagagaacctgctaccctttgcagtgcagtgcagaaacctcactgtgtccaatacccgaacagttcttctcaccccagagatctatgttgaccaaaacatccatgagcaactggtagatttgatgttagaagccatccagggagcccgtgagtacatgaacaagatctgtaagcttctacattttgattttcagatttaaaatttcactaattgcattagaaagtctcagagccattatggttctggtataaattaaggaggagggctcacatcttgatctttgaggttgagtaccaatagaataaagctgggcatggtagcacacccctgtagtcccatctactctggaggctgaggcagaaggatcccttgagcccaggagtttgaggctgtagtgtgctataatcacacctgtgaatagccactacactccaggctgagcaaaaaaacaagacccccagctcta

SEQ ID NO: 413364 - DNA, 460 bp, Homo sapiens
aaacgtaatgagatttatgcacagacctttctatttgctcatcaggtatcgttagtgttagtgtattttatgtgtggcccaagaaaattattcttcttccaatgtggtgcagggaacccaaaagattggacacccctgctctagaacatgtagccattttgagttatcatcctgaatttctctccagtgaatatatcttctcttcttttgagaatgatgtattaaattaagttgtttaaagatatttttaaaaaatgtttactgtggtacttttcaagcatatcagacatagggagaatagtaaaaagaattggcatatgcccttcagcaattatcaaatatgggcaatcaccttatttataccccctccacacccactctctcatcatgactggattatgttaaagcaaattctagcaatcatattattttctttgtaaatgttttgaaaaatgagtat

SEQ ID NO: 413365 - DNA, 832 bp, Homo sapiens
acagaaaccagccctttggaaagactggctctacctatgataccaacgagccctcatgctgcccctcccttacagttttgacacaggactgaccagcattccttccagatgagagaccgctggccacagagtggctttggccagtctacggacactgcacacagagggcctccatgtcctctgctttaccttttgatgtttagagcctacttgtaatacatttaaatgttaagttgcctctccaaagtgagcagggaagcacgttgcatgcctgttagctactacacatgcccttgcctcccttttgtgagtttccatcgctcctcctatgacctgctgaacatgtatacttagccaacctgctcagcgtacattccagttcccttgaccccctctcctgaagtacttgttatggaggttacacttcccagcctgcaagatggccagcctgcaggctgcgatgctttatgagaaataaagctcttttaccaaatttatgaacctcattattcttcagctgcagatttcagtttttcatgttttcatttcagtttttcatgtacagtgactaaacatattcattgaattgatgacctgcattagctagtttggttaatgatttcctataacaaacttttgtgaagtttatggtattttcattgatgtaactaatttgtctcaaatccacaagacatttaaatcttacccttaatacgttcatgagattcttgcatcttcattgattagattttccaataatacaatggcctgttcatgattttgactcagaatgtatttgttctttttgatggattactttttgaattatctg

SEQ ID NO: 413366 - DNA, 661 bp, Homo sapiens
gatgtaagctccatgagagcaggactttgtctgccttacctcacatgtcgcccaacacttggaaggagttcactaaatctttgttggatggatggatggatgatggatagcggagtggagtttgtcagtgctggtgagaccctcagacggttttccaagcccaactcaccgcatattagctatgtgaccttgggcatgtagcttacccctgccaagtctctgtttcctcatctgtcacctagggacatcattcctacttcttagagtcatcatgagaattaaatacaatgcaaaagtgtgtggcaaagtgaaacaggccaggcatctaaatgctaactatgatgattttcattatctctctgcccagattagtgtcatctttgatcactctatctacatccaagttatcaatatcccttcaatggcacagcactcaggacagcactgccactaaagatgccaccatctggctatgctctaatcgggcatatgtgtcctcatcccatctgcagagggtctacaggggcttgcctcttgttgccagcactgcctggctctgcagcctactcaagaaaagaaaatgaaagcagcctgactccattcgtcatgattccttcttttccttttgaggctcacagacagaccgttggccagcctcgcc

SEQ ID NO: 413367 - DNA, 728 bp, Homo sapiens
aagtgtttttgtgacttgtctaaagtcacacaacaggatcagaactaggatctcctagctccaccttaatttattgttcattcattcatttgctcactcatttattcatcaaaagtcaattggaaacaagctaaatatttctcagtagaggactgcttaaataaatgaatgcattaataaatgaagttgaataaaacggtggtatctatcctaacgatatgttctaatcaggtgaagaaacagataatcactgaataattagagtgtgcttagtgctttgaaagaaaaaatgcttgagatggcaggccagaaaacatgtcacggaggaagtaccatgttaatggcattgaaagttttacagttgcatggtaaagctctataaacataaggagagctggaaatgattagagaaaagagttaaattccttccttaaagagaaaattcattaggcccagagtggtggctcatgcctgtaatcccagcactttgagagatcgaggtggaaggattgcttgagcctaagagtttaaggccagcctggataacatagggagaccctgtttctacaaaatataaaaacaaatctgccgggtatggtggtgcttgactgttgtctcagttatataggagggcaaggcagacagatcacttgagcccaggagtttgaggctgcagtgagcaatgagcatgccactgcactccaacctgagcaacagagcaagaccct

SEQ ID NO: 413368 - DNA, 758 bp, Homo sapiens
ctgtctctactaaaaatacaaaattagctgggtgtggtggcacatgcctgtaatcccagctactcgagaggctgaggcaggagaatcgcttgaacccaggaggtggaggttgcagtgagctgagattgcgccactgcactccagtctgggcgacagtgtgagactctgtcttaaaaaaacaaaaaatacaaatgaatttaaaaaaaagttaaaaatacaaatatagcactgtaaacatctgatatgtatcctttcaaacttttttctgtatatatttatttgttaaatttgtattgatgccctcctttagtgtagactttctattaagaactggaaacagagccaaacaaaacttttttttttttttttttttgagaaagggtctctgactcccaggctggagagcagtggcacagtcatggcatactgcaccctcaacctcccagattcaagcaaccctcccacctcagcctcctgagtagctgcgactacagacacatgccaacacacccagctaatttttgtatttcttgtagagacagcattttgccatgttgcccaaggtggtctcaaactcctgagctcaagcgatcctcccaactcggcctccaaaagtgctgggaatatgggcaggagtcactgcacctggcccaaacagaacttttgtctttatgtagcgcaccacaaacataaatacttggggttttttttttttatttaataggatcatagacatacttaacttgatcttatttcca

SEQ ID NO: 413369 - DNA, 810 bp, Homo sapiens
ggctttcaagatgaaggaagggggccatgaaccaaggggatgcctctagaagctggaaaaggtaaggaaacagattctcacctagacttccagaaagctctgctgttgccttgattttagcctagtgagacccatttcagacttccgacctccagtacgtgaagataatacatttgtgttgttttaacctattaagttctaaaatggtgaacccaatttcatttcttctctccctttacaaggtaggtgctattaacagtgaaatgacaatgcaaaagcaaagcagaggaaagcaccagcaaaggacatgcctcgctgactgcagattacagtgtcctctactcaattcctatcttaatatgtatcacatgccctgcctgagataatgaggactctcccattccctcagtcttcaggttgcctctacttctcttccattttctttttccttgatatgatcctcttctttctcattcttctcttctttcatttcctgagttgttttctctccacttcttccccctctactctgataggaaatattatagcagtagcccaagctagaagaaaaaggacacacctaccagctccctccctccctcacaacacctacacggctgctggggaagccttgaatgaaagctagaaaagaacaaataggaaaagaggcatttgaaaacagaacagaaatagtcacagacgggtgacaggcaggagatgccacctcattgacagctgccaccattttccatagagaagttattccattgtagtatacaccagggctgggtttaaatatttttcctatgt

SEQ ID NO: 413370 - DNA, 348 bp, Homo sapiens
agagaatggcgggattgggagcgcgtcctgccaggctttgacccgctccctccaactgcacatgcagccgctgcggggacgccggggttggggctgggggcggggaaggagcgtccgggagtgggccgtgcccccatggattccagaaacccgcggcccggagtcgcggggcgtcccgagggagacctggcccctggtgggaggcgggcgctcctcgagggcggggagttggcgggaagaggacgaggccgcgctcaccggattcagacccagaaaccacttcctccaggcatcccggcaagaaacgggcttcggagacggcggccacccctctccctgcctaggagt

SEQ ID NO: 413371 - DNA, 602 bp, Homo sapiens
gctttccagcccagggccccgctgcacggcacagcagattgagagcatttgtaataattcatagatctcactttcatttttctgctgcccaggaattacattccactattaaaatgcgctgggactgcctggcccggccgctcctgcgtgttcagacacaggtcgggcgaggaccctgcgcggccccaagtgggctgcggctccggggccgggcgcttgccccctgctggacacacggtgcactgcaggcagcccagagggccctccccgcgatgcgggtgagaaagtcccgagacaggcccatttcctctgagatggccacggttccaggtgagaaagcaggcgggagggaagaagctggcgtccaggcccctgtgcagtcacatctggtcctctgcggtccgttcctgttcttgggatgctggcagggggcactgccccagctcaggggcacacaagacccagatgggtgcaggcaggaaggccagcttggtcgggggggtggggggcccgggccgaggccggagccgggacagcccccaggcgtggtcgggccctggaccttacctactgcagacccagtgggtcccactcctcttcag

SEQ ID NO: 413372 - DNA, 906 bp, Homo sapiens
ccttccttctcccctctcttctccctcttcctctctcctcttctccctcttttccatctccctccttttcctccttctcctctcttctcctggatttttccttctctgccctctcctcctctcccttctcttcctccaccccatgcatttccttctcttcttcctcctccttcttcctgctctttaccctcttcctcctttctctttttcttctcactcctcctctccgccttcttcctcctcccacttctctccctggctagcaagacctccaggaaaagacctctctccctctgacccattgactggttgactccaagtgcagggtggagctgggcactagggatcctgctgagggtctcctgactcaggacttagagtgctgcctcatgctccaagcacaggcagggcatttgaggtgagcaaacaccatcctggagttatggagctgctgtgacagcacctgcacctctcccctttgtcacgcctcattgaaaacactgtgacaatccatctctcctcatccccactcatctgtatgagggtcacccctgaggtcaccaccactgcaccaccatcaccaatacagcttaagccaccatctctatggcttccaacaccatcccttccatcctctcacagcctccatggtctccttatagcctggccacttctatcactatctccagcatcattagcatcatgctggttaccacggaagagctgtcaggacttgccagagactccagtgtactgggttgggaaggaaagaggctcaactgatctgttcatgaagctccactcagacacacagaataggcccagcacacagaggccttcaatggcagggagaccagggaagggggccaggaagagggcaaagagctagaattgagcctggctaca

SEQ ID NO: 413373 - DNA, 626 bp, Homo sapiens
agaccctctctttgtcttgcaaagctgtttgctatacaaacgtccctgaagagatggtccacaagaaaggcagccagtgcctctgcctctgcccctgtcctgaggtattcacaaaccaagagattttggagaactgtctcccaacaatcaatcaatcaatcaatcccactgattttgtctttctttcttcctttctttcatgccctttcttttctttttctttctttctttctttctttctttcttttctttctttctttcttcctttcaggatctcattctgttgctcagcctgagtgtggtgcgaccctagctcactgcagccttgaacttctgggcttcagtaatactcctacctcagcctcctgagtagctagggctatgggtgcatgccaccatgcctggctaatttttaaaatttttctgtagagatgggggtctcaccatgttgcctaggctggtcttgaacgttgttttcaaactaattatattctttcatttttagttccttccttctattttccttatattttaaaaaatattctttttctatttttcttgagttggataattacttccttcaccttcactgttcttaagctaaaatgattttaagattgtgactt

SEQ ID NO: 413374 - DNA, 711 bp, Homo sapiens
cttgaaggcacaggcatccatcatccagggtgacttccagtctcctggttggggagggctgcacagaactttggaggagggcaggtcaggctccgctcatgaggtggccgaggagcaggacatggcacactcattcgcctgtccttccacatggccaacttctgctggccttcccagagccctcaaagcctgcacattcacaatcctcatggacagaagtggatacaggctcagaggccagaggtactaaccgagaccacacgattcagctggtcaccgtgtcttcccggaacctgcacgattcagaccaaagctgtctctggggttggcgtgtgttccccaaagaggaaacgtctccatgaatttggtactctaggcacttcgctggactcatcttaactccggccctgtaaaggaaagaagtgaaagtcaccccttttcacagcctgttcacccacacccacctaggtcttctaggtgatcagacatgggtcctgctctccaggagctgccaatccgatggaggaggctgacccttaaacaaaatcacgaccgtcagagacaagagcaaacagtgcgggcaaaaggagagcccagatggaggggcccgtggggtaagtgggtgtgtgcccagggaggggttccaggagaagaggccccacagctgggccttggagggtgagggtgtgtttggccattggcaatgccccc

SEQ ID NO: 413375 - DNA, 852 bp, Homo sapiens
gcactttggcgctgttggcgacggtggggagagctgtagagtgtgaagttccttgtctgctggcagccagaggcgacgagtctggacctcatggaagtccagactctagtctgggcgcgtcccttttgacggagtctcgctctgtcacccaggctagagtgcagtggacggtctcagctcactgcaagctccgcctcccgggttcatgccattctcctgcctcagtctccagagtagctgggtctacaggaaggatgtcgattctgcgcttctcagtaactacgtgagactagattttgctgtgttgcttcaggctggtttcaaactcctggctcaagtgatcttcctgccttggcctcccatagtgctgggattacagacgtgaaaatacatatcaaaaacactgtgcaggcaccagagtcctgagattgtcagagaatttctcacagcaatgaaaagccacaagttgaccaaagttggggctttcccatgtgccaagactggtctcgaagtactggactcaagcaatccccccaccttgacctcccaaagtgctgggattacaggccgagctatgacacccagccttcagttatacatttcaaagaacataaaataatttccattatattcatttattctttcactcatctaaatacttattgagcatgtactgtgtgcactgacgctacgtgccggggatccagaagtgaacgagccagacaaggtgctgcccttgtggaccttaaattctatttagggaagagaaacaataaacatgtaaacacattccagattacctgcagcaatggacacaccttgtaacagatacacaggaaaattagaagggga

SEQ ID NO: 413376 - DNA, 695 bp, Homo sapiens
tctcaccctactcatttccctgggaaattgtacctacacctgttattgatattttgatgacttccatatctgttcttcagctctgtggtacattgcaaagcctggccagaaatatttgttgctcctcctgtcaagcggtggagttgatttctccaaccattgagtctggctgcctttgggacttgctttggagaacaaaatgcagaagtgatgctgtgccagtcctgagcttggacctcaagatattttgcacacatatgcttttgatcttggaaccccttatcctagcccagtaaactgggctgaactgatgatcaaagacgcctccttcaccgtgtctacaaggccctctgaaaacacctggtcctctggcgatccatcagttaactggatactttcaaaatataattttaactatgtgaatcacctgaagaaattcctataatggttcaaattctgtcataatgtccatgagcttctgctggactcacagccttgactttaatcctcatataattgggaaacattaaatattcttgaatgttaacatgtcagtaccagggctctgcttcaagagaactggtctgggagttgtactgagcatgccttatggggaaactttggatgtaagaagagaaattaagaaggcctttcatacatccagcgagaaaagatggatctcaaacaagactggt

SEQ ID NO: 413377 - DNA, 722 bp, Homo sapiens
ccggctgcggcagccccggggatgcccgtcaggcccggggcaggtagagccgccgagggaaccacgggtgccagcggccaggctcagcgccgcattcctgacccattgcctcatgagaattgcctcatggtgattccgaaataaccctgctcacttggggaggctccttgggacacgagaggggagttgcgcggggccgggcccccagtggtctagtcgttctggctcactgtgccactttcgtgcatttggggacttcacgcaggacccctgacccttttatatgcctctttgtgtcttcttttcctcctacccctcacgtgccagaaatggaaaaactgactgtatctgcagccactagaagtatttccttcctctgcgatcttcgctttgggagatggaaaggaagggagccgcatctcgttatttaatccttcactgcaaccttaacagtcaggtcactttactggtacccgttttatggatgaggaaaccgaggcccagaagcaacatgctagtaaatgacaagatttgaaacttaggaggattagtgagttaatgagatcctttgaaaggtcagggtaatactactactaatagctaacatttgcttagttctgaccacagccctatcagatggctactattatccccattgtaaagatgagtaaaccgagtttcagaggttaagtaaattgcctaacctcacagctagtaggtgg

SEQ ID NO: 413378 - DNA, 796 bp, Homo sapiens
ctagtcctgagccgccgggtgagggtggggaccggggggcgccccggcagggggagccgtcgaggcgtccgcgcgcccgcggacccgacggccgagcgggcagtcggggcttggcgagcccgggcgcagggggaggcgaggaaacaccgcccccgcgcaccccgggcagagccagccgccgccgctcgcctgcgaaggcgctgggccccgagcccccaagggcgcggaggcagggtcttcagggcagcgcgcggcccgctcccccactcggttcacaggcgccgggacccaccccgctcccggctccggcctcggcacgttcctaaccccctctccaaagaggattagaagaaaaatgtgttccacacttggggaaaagacgctctggagactgtgggtctgatttacagcagaaaaatccgcgcaggcgggctcccctcacctgcttccccgctcccaccgcccacgtgcccccttccaaaaagcccctccaggctgggtgcagctgaaacccatgcagacccctaggggtggtgcggatctgcgatgtctgtgcccaaaactcccgctcagaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaagctaccttaagaacgcaaaagttccaggggctggccgaccgccagctctctaaccccagaaggcccgtgaagggagggccc

SEQ ID NO: 413379 - DNA, 1005 bp, Homo sapiens
cgctggtactggtcggaattttgggacacagacacactccgtcccacccaccaccagcgctctggagcctgccccgggccagggaacagcttggcctgatcctgctgacgcctcagggcaggacagggcagggaggctccaggcggccacccatgctgggcacacagtggactctcgcacggtgtcttctgccgtcacaccctgacccagggctggccgggagccttcggggcgacagctccgaggatggacgtaggggccagctgctgccccagagtcctgccccctgcagccctgtgtggagccctgggactcctgtgggtgggcctcaccctgctggggacggtccagccacagcgccagggcccccagaggggcctgaacttgcctttccacaagatctgtctccagcctggcctcagaaaggagcggggacccaccctgcaaacgctgggccaggacccctgtcccggagaagcagccagctcagaacccccttggaggccgggaggaagtggggttggaaaatgacgagatggaggctacgccgagaccaagcgccaggagaagggacccaggccaagctgctcggtgaggccctgagcacggcgggaaggggccatgcaggaccccctgagggctgggctggggagggaggggtctccccagggctcaccccccttcttggcacagggcaggggaaggagctggatttagacctgagggagaaatttatcagatttgaccagatcctgggcatcagccttgaccacattcccttcctgccccagactggccccggcaggccttgggggtgtggggtaggcaagcagagaccacactgatgcggggaggttggcccagagccctgcaggccaaagcctggggccgggcagcagtgtccgccgaggagagggtgtctggtgcctgaatgacacaacctgagaggcaccagccccaatcctgtccgtgcagcccagcggggaggactgcccaggagaccat

SEQ ID NO: 413380 - DNA, 732 bp, Homo sapiens
gggagcggtggggcacgattcagtccactgcacaccgttctcctctccagacctctcactggcaagtcctttcatctcaatttcagttctgtgaggccgtcctactattgtctatcaccctgtttgatttttttgtagcctcatcatttattcattacagtttcttaagttcttttttttagggagcttgtcattgcctagaagagtgctgggcacacaatagtgatactgaatatacaactaaaatcatgtaatatagcacatgagattcttaatgctaaaattaagactttttaacatgaaaaatgctcttaagggcagaaatgaagcaaatttcaggcaagatggcagacaagactgaaacggattcatccatcaactgctacagacttaaaaaacaaaatatgcccaatgcaaagctgagctcaggaaatcctcagatgctagagataaagacaaaatccagttgcagaagtgagttccaggtgatgccaggagaccccaggaagtatcagattaggtcacaaaactaggaataaggttttaatgtcttcagaaaaacagagcatttggtgagagaagggaactaatccgagactcccgcatacaaccaggacacttgaagggctgcctcacctgtgaaaaagaaactggaaaaatctcttcaaatctgtctgtggaaacagaaagacagcctggtgtttgacaaagctctcggtgggacaaacctcc

SEQ ID NO: 413381 - DNA, 639 bp, Homo sapiens
ccagcctccaccaccagataaagctgagctgtcgggctccctccccgagtcacctcctgcagggggattctgcaggggagagacccagcaccccccaccacttgcagggctggacaggaaggggagaggagccttgaaaatcctctccagccttccagtgcctggacacgccccctaagaaatctgggaggcaggcaagaagccttcagaacatctgctgatgactatttattgaacacctactatgtgctctaccgggggggagactcaaacacaccagcaggcaccaagagtgagcacggtaggccagatgctggctgggcagggacgccgctcaggggcccactcaaacctctgcttcttcatgaggaaaggccccatcaaaaggggggcaaaacaggggtttgaggggagaggggttggggcgcttttccccccaaggcgaagttttaacgggggacccccatttccagagaagccaaagaaaaaacgggaaaagggcccaaaaagtcgcccacacacacaacacgcaccccgaagtaacaacgttttaaagacagatagaagagacccttttaaaaccgtttttggggccccgttggggtctccacaaggggacacacaggggggggaaaaaag

SEQ ID NO: 413382 - DNA, 576 bp, Homo sapiens
ccacataacagcacctaactgacattcaagagtgtgtagagtgcagagtgctgaaagagactatcaagatctagctagtttaaagatgaaaactgcagcagatgagaaagaaaaatacaactggaaaacttggatgaattagaaacactaaacagttttcaggaaagctgagtatcagagaaaaacagatgctggaggaaaagaaaaaaagaggacacaaaaactgtcctggccaaaggggtcatgaccacacattatccttggatgagggcttcctttatggtgacaattgaacagaagcatttagagcagattacaatgcatattatacgtacaatgaaatcattgaaacagaaaaaagagccaaaattgatgtctttgccttaaatcttgcttctttctagtttattctctccacagtggtcggggcagtctgagagaatacggtggaatcgatggtatgcgacttccaaggttaggtcataaaagacattgaagtttctgctttgtctcttgaatcactttctctgggggaaaccagctactgggtcataaggacactcaagcagcaccatg

SEQ ID NO: 413383 - DNA, 617 bp, Homo sapiens
tctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtg

SEQ ID NO: 413384 - DNA, 675 bp, Homo sapiens
tttctttttgaatttattttcatttagatgggcgtcccccccacctcccgtttccacctcttctaggggtgtaactatagcgttagtatgttgggtagggtcttttgggttcgcttctaaggccctgcgcgattctgtctgcaggttttatattggtctgtgcagtttgacctggagatcttctcactcagatatggcaacaagcagccttcactttgcatcatgtgatacacaacaggcgcccagacagcgcggagcgtctactgtcagcagttcatcatcaaccaaggtggatctcaagagtggcctcgaagaatgtgctgtggcattgaacttatttctaagcaacaaatttacagacgccttagaattgcttcgcccctgggctaaggagagtatgtaccatgccttgggctacagtaccattgtggtgttgcaggctgtcctgaccttcgagcaacaggacatccagaacggcatttctgccatgaaggacgctttacaaacctgccaaaaatacaggaaaaaatacacagttgtagaatctttctcaagtcttctttctagaggatccctggagcaactgagtgaagaggaaatgcatgctgaaatctgttatgccgagtgtctcctacagaaagctgcactcacgtttgtgcaggtaatgaatatttg

SEQ ID NO: 413385 - DNA, 160 bp, Homo sapiens
cgcggcggccggagccctcttgggacccatggtcgccctcagtcagcgggactgctcccgggaccgcgacggggcggggcggggcgctccagcgttgtttgagcccaggcgcggaagggaaaaggcctctgagatgctcgcgtgttttgcctgggcgcgg

SEQ ID NO: 413386 - DNA, 540 bp, Homo sapiens
gtttccaggtcacctgaccggtctcctttgctgtcggcgccaagtcctgcaagtttgcttgagagacgagaaaccagcaagagttgggcaaactttccaaaccaggcttttccttcagtgtggaatctaggcggccacagtctggtgccagctgggtcacaaacagctccgtgacctgtttgtaaacgcgatgctcttagttccagactaaccgctcacaagggtgaagcacttaattaattcatctcttaatcttgttaggggccaacggctcctattagtgtttgagcgtgacggcgacggtgctgtttatgaagccctagcctatttggaggtgaggaagaggagtctgtgggtaacctggaggtcgacagaccgggaggaacgctcgagggagcaccaggcctgttacaacgagcgcgcgccgacgcacgtctccacccacccggcgcaaccgccagagcgcgctcccagcaaccgcggctctcgctgcgtttgtagccatacgtcacggcctcttctgcttctcattgggggagc

SEQ ID NO: 413387 - DNA, 526 bp, Homo sapiens
ctggggctcagcggtgcgcgtcctgataaggagactgcgccttccagggctctgggaagagggccggggcaccgggcagacagatgcgcgcacacacatagcgcaggcacaccgctagcgagcaaagtacactggaacaccggcactgagggactcccacctggcagcagtcacctccgcaccttcaccgaccactgcagggagccccggtgacagaagaccccttcctgggcagtgtggacccctgctgttcagagcccactctccatcaacttgagttgtggccttggggctagtttcctctttgggcttcttttcctatatctaaagtaaagggttggagggaatctgcacaatctgagggctgatgtgcagattccaggccacacaggcctccgtcccctcccccactctgccccaggcttgtctcggaaactggggtcctcaggaggggacccacctcttctgggcatgggctaggggcctcctggcctcccagcccgtgggagtcaggcccaactctgcc

SEQ ID NO: 413388 - DNA, 704 bp, Homo sapiens
caaacttctttgcaggaactgaagaccccggcagacacatgtcacttcccctcagaattgctgcccggctgagctcccggaaccctggacctgtcctctcttcctcttcactcaggcccagccttgaggacgagcttcttctcttttggttattcccagagcacgcttgttatcacacaaacaccattttcagttgctccatctcttcaaaaataagactctcctgacaacacagtacactgaacaaccctgaatgtcctgtgcggccacggccactcagccctacctggggaggcagggccctgccagggggtgacccagagtttcctgctcttgggtcgtccaggaggcgtctgaagaatgttcttaggctgctagttacacatcagtccaaagcctcagggatgatgaggattttgaagctattcaggcacctgaggctgggctaagactcccactgtcacctgtacctacttccctgtcaccaggagggcctggctctgtcccacgcacacctggtctgcacactcacctgcaggcctgagctccacccggggctgctccactccagcccgaaagcctccctaatgagggaggttgttcagtctcacctggggcttgggggtgaccaggtggaaggttattgggggcatctgcgcacctggtgagatgggcacgtgttctccctgagagcacagctcatg

SEQ ID NO: 413389 - DNA, 690 bp, Homo sapiens
cctactcaagatggagtcgctctggtttgaacgcctctgacacttccactctcaaggaatggtgtttttattctcttctccccagaatgtacttctggtctgtcccgctgttccattccacagcattttaggaggttctcaagagtgtcctaaacaagcagagaagaatggtgagacttacccattcctagtttaagaaatgagtgaaatggggtctgagttatatcacagctacagtttagactcctgtggtacagttggctttcccaggctcccggcgtccatgctgtctcggcgctatctcgcagcctgacgccacgcgccatctgctggccttgagctgcatagctctagagtaacttcagaggccacgggggaacaaagagcactcgcctacttgactgagctccgacaggccgtccctctgcttcaggtgtaggcgtgaacaagtccagaccactaccttaacagtaacaagtacttgacacatgtccttggtctagaaaggatggaggagccacagacagctgaggtgcaggctccagctcaatggcctgtcattacaagaggctcttggagtttctgatcttcttcgcctctctctatgcccaaccctgtctagagtgcacctcagcatgattttagaaaacagcatggagaaagagaagttgaggccagtctttctcctcc

SEQ ID NO: 413390 - DNA, 804 bp, Homo sapiens
caaaactcactcaataccactgactacccaagttgttgtttttaatcaaagcaataaactgttcttaaggagttcaaggttgtgaacagacaaaaggattcccttatgcatttggggttgtgccaggcattttgaaaaagtgatgccccagctcctctgtgtttttgcacttaaacatcttggacatttggagccccccaattctgtgcccatagatgacagaagatgttacaatatctgttacattggatagagagtgagaagggagaaggcagagtgcttgcacttctgtaccaatgtattaagccaaacttattgagtgctaaggctcagaaatacaaaagcatttgtctttgcccctgctgcccctgagaatttcagtctaggagaggaaaccagtcaatattgaataatacagcaaattattcatgagcggctctctgtgtctccagcagtattctaagagttacagactgaacagtacaagaacttataggtgttcttgaagtcattacttactgagaaaagaatcactatccaagatgaaaaatcaggaacttcaacaacagctcctttatttccatttctacttctgttggtgattacactgttccattttttactccagctaagtcattttcacctctgtattttttctcctatggggcaagatctgtgatatctgatagtttattaacaggtgtgctggaaataatctatttcaaaaataaaacactaaatatagcacacaagttcaaggcttttgaatgttaccatggttttaaaaaatcaatgtcatgaatg

SEQ ID NO: 413391 - DNA, 748 bp, Homo sapiens
  misc_feature (747)..(747): n is a, c, g, or t
gatgctgcttcagtcacctgtctgtccacaatgacaatggggcatgaaaaaatgccctaactcagggcataataaaataattagcttttatttagtaaaaaaaaaaaaaaaaaaaaaaaaaaaaaaaaaaaaaaaaaaaaaaaaaaaaaaaaaagggggggcggcgcgcgacaagaagaataatcctccccgcgaggggcgccacaatttgagcgcggatgcccgcaggcgtgttttgagcacaaggggggccccatataatagaggagcgcgtaaataataaagcaagaagcacgaggacccgcggagataaacaacacggcggagacgggggaaaaagcggcgacaccgcgggaggactcttgtgggaagagaggaacgcccattacatctatcgggggggggggggggagaaatatatgtgggggggagagaaaattcatctatctataagaagagagatatatataagagcgcggccttgagagggggggggaatatatatatacaaacaatgttatgagaggcgggcgtgtgatatataggcgggggtgtgtaacaaaacaacaaaagcgcgggtgacaaatatagtgtgtggctgggcgcggtgtatgttgagaagaaaaagtttgtgtggcactcatagcgggagaagtattatatgatgtatttatgtagggaaaaaaatatattttttatacacaccgggggggggggcttgttgttgagtatgaattaaaaatgatnc

SEQ ID NO: 413392 - DNA, 727 bp, Homo sapiens
cacagacaccacgtgagtagtcaggcctcagctgttatttcagcctcagggatgaaaacatccgaacagtggaatctttttttgttcctggctccagtctcggaacccacagactttggattcaccgtagtctccacctatccccatatcaagcggatgggcttcccgagtctcagctacccgctctttcctttgtctctggcctgctctgcgggcactttcccacaaggcctgggaccctggagaacctaagtcatcgctcgagggagagtttactgggttcagggtgaggctggtggaaggaacatcgtggtggtacgcctggggtctccacggggaagaggacaagggggacttccaggagcttcagcggcagccaacgctgcgagcctcatctgcgtgcgcccctcgtggcgctcgcgggaactgcgggccgacgtcccctgtttctctcgttgatttcgccagctctgatgaggccggagcgggcctcttcagaggaatgtagactgtttgcacccgaaaaccaaaaccgtgtccaaggggcggggccggcctgctggcatctagaatggggcctggcagagtgggcccgggaggtggctccaggcccagggccagccacgctgctttcccacgtgcacaggcgttggcttcctctgaaccagactctggggggagggaagaagcctccgccgggaaggagagctgggggctttcccttctg

SEQ ID NO: 413393 - DNA, 747 bp, Homo sapiens
atcatcttgatagagtcccatagtgtctcaaagtggggaggttaggatgctggttagtcatggagtattttcagagtggaagttgatcagtgacgttttgtcagggattgatccaatttataaactaggtaaaagagaaagattataatgtatattcattcatttaattcataatcgttcctgtggatttgagagtggttatatgggcagtcacccaggaacaaaggacaagaggattgtcacttatgccttcaggaaatgtttattgaatgtctactatgggccagaaacaacagacagaaatgcagctctcattctcgtgtgggaggccccaaactacaatttcaataacaccattaaaatcttgggcaacaaagataatatgtaattacctgataaattcgaaagatgtgatgaacaaataaaaaagatcgtcttgagccagaatacacacgtgtccttccagcgtggagattactgtgaacttgcaaaccagctttcgtgcagaagggggcgagagaataggtggaaaagaatattgtcaaataattttgaaatttatctcctaacattttctgaccatctattattgagaaaggaaacagttttttaaagcaatggcatgattgtacagtaaaccctgaagtgaaatatacccaaaaaatgtatttgtcaagcaatcacattttgataacttacagacatttgcaatttatctttcttttttcctcaaatggggaagaacaa

SEQ ID NO: 413394 - DNA, 190 bp, Homo sapiens
caaatgagaaagtaaaagtgtatgcaggagtcaaacccactttctagaatgtggttaatttctagaggcagctgggtttcctgtggagaagacaggtttgcctacgcagcgtagagaggagacggctgtgtgggctccagccccaggggaagtagggcccgggggtcaccgcgaggaagctccatcggcc

SEQ ID NO: 413395 - DNA, 309 bp, Homo sapiens
cgccagggaaggtcaggcggcccggggcgtcctgcgactgcccgaggtcggaggcccggaggacccgccgccgcctttgtgtcaccagcccccgccccgctggactggcccgggccggggcggttgggccggcgctgaagaggcttggccgcccgggtccacccgttcccggatccgcctcgcggcccccgcgcccgcccaacccctgcccaacccctcggctccgcgagtttgggtgagaagtgcggcggcttttcccagggatggagtttagaggacgctaatcctatgtgcgagcggcggaccccg

SEQ ID NO: 413396 - DNA, 792 bp, Homo sapiens
ctgtgatgtggaggccatagctccactggactcatgaggagactgaggctcagagcaatgaagtgacctgctcaaagttaaggagcttcagtttggacccaatttgttctgatcctaaggtcactatccttaatccctctccctgtggggtcttccctatcttgagcctgtggacagctgtgcagtggcaagaaaaaggccttcagagctacgcagacctggcttcaaatcccagcctccctgatgagccctggtggtcttgcatgcttgcccttgggactcagacaccatattgtgaggaagcccaagctacatgcagaggccactatagttgttctggccaacagcccaagcttcagctgccagacatataaataaaccaactcttcaaagtggaaaaaaaaaaagaaaaaacaaaagaaaaaaaagaaaaaaaaaaacaaaaagaagggggcgcgcgcgcgcgcctcaaagagggcttcccccaggggggcgcgccacatttatagcggcgccgccacgggttttgttggagcaaaaagagggcgccccacaaaagagggagggagacaatttaacaaaacgcggcgcgccgagcgccgcggtagcataaacacacacggccagagagcgggggacaaacccggcccaacaggggagaaactgggagaagaaagcaccccacaacgacgggagggcggccacaatgatgcgggacacaagcacagccacaagaaggatatagaaagccaccagaggcgcaacaaacacaaagaagaagagcatagagac

SEQ ID NO: 413397 - DNA, 333 bp, Homo sapiens
cgcttccagggcccacttcagcagtttcttccggacccggacaccctcagggcggcgatcgggggtgaaacgcctcgggccgagcccctgggtcactgcgtcctgagcccacccagcaaaccccgagcccaggcctgagcggcgcccccgaccccgtcccgggctggagaggccccgcccgcggcccccggcctgaccccggcccgccccggcccgcgggcgataaggccgcgcctttgttcctgcccccagctgggtaaaccgcgccccgcctcgctcgccgtctcgggggcacctttgtccggcccggggcgcgcattgtccgcacggtgt

SEQ ID NO: 413398 - DNA, 684 bp, Homo sapiens
gagttgggtgcaggcaggtgccatgggcccgcttgaggcacactgaggggacgcggggctgggccatggccggcgctcgggccgccgccgccgctgcctcggcggggtcctcggcctcttcaggcaaccagccgcctcaggagctggggcttggggagctgctggaggagttctcccggactcagtaccgggccaaggatggcagcgggaccggcggctctaagtcgtcttatcgccagacctggagggcttcctgtcagctcaggccatccccaccctaagcactggctggcagtgcggtgggaatcttgccgaccctgccatctcattcccccacgtggttttggcagctttagcaccaagttttccagtggaattctgttccatcctgcaccacagaactctgatttgacctcagagattaccgttgagcgcattgagaagagatgtctggagctgtttggccgagactactgtttcagcgtgattccaaacacgaatggggatatctgtggccactatccccggcacatcgtgttcctggagtatgagagttctgagaaggagaaagacacgtttgagagtaccgtacaggtgagcaagttgcaagacctcatccaccgcagcaagatggcccggtgcagaggacggtttgtctgcccagtaatcctgttcaagggcaag

SEQ ID NO: 413399 - DNA, 440 bp, Homo sapiens
gtccgaggcagcccactgctctaagcgcttggtaccagggagggaatgggaggacgcttgcgggatagggaggcgggggctggaaattggcagggtgagagctggggaaactagtctgggacgcagccctccttgtcccccttcttcattcacccccttgttgaggcccttggcttttgcataattatggaagctccaaaaggaaagataccagattgatcttgatcacctctgcctccccagcacctagtcttccttggcacatcgtgagtgctcgggtcaggctgtgccacatccacccagccttgcctggggtcatttatcctacatgtactcagatcacgtgaactggtgatgggccacccatgtgcctgcctggagactcctattcacccttcagatcaatatcccccaaataaactcccagtcactctggcatc

SEQ ID NO: 413400 - DNA, 371 bp, Homo sapiens
gtccgaggcagcccactgctctaagcgcttggtaccagggagggaatgggaggacgcttgcgggatagggaggcgggggctggaaattggcagggtgagagctggggaaactagtctgggacgcagccctccttgtcccccttcttcattcacccccttgttgaggcccttggcttttgcataatacaccctttaaaaaaatgtatttaaagaggctggttcctatccatccgactggaggcatctcagtgcaagagcaaagctaagtcctgcacacgctcctcccctcctcctcctccttctccccccaggttttcccgaatgtatctactccggttacaactagacgcggcccctcccccacctgcctc

SEQ ID NO: 413401 - DNA, 450 bp, Homo sapiens
gttgcttcaaaccttctgattcaaagctctttctctcttcccttctctgacttccttggtgccttgggagccctcctgcctcccttggctgtcgtaaggctcatatgagatggtgcatggaaaaataggttaaagtattgttttaacaaaaaagaaaaaaactgcttaggttgggcagggtggcccatgcctataatctcagcactatgggaggctgagatgggaggcttgcttgagcctaggagctcaagaccagcctaggcaacatagtgagaccccgtctctacaaaaagtaaaaaacaaaacgagctaggcatggtggcacctatagtgccagctactcaagaggctgaggtgggaggcgttcgtgtgagcctgggagatcatgactagtgagctgtgatcgtgccactgcactccagcttgggtgacagagcaagagcctgtctc

SEQ ID NO: 413402 - DNA, 857 bp, Homo sapiens
gctgactcaagaaaaaataaaaatttgaatagacctgtataaaaagtaaagaaatttaattagtaatttttaaaattcccacaagcctaggcccaaataccttcattggtaaattgtaccatttgtttaaagaacattaacaccaatcctttacaaatgcttacaaaaatacctgagtaggaagtacttcccaacttactcttgtcaagtcagtatttccccgattccaaaactagacaaagcaaacatgaaaaaacaatgctgaccaatttctcttgtaaatatagatgcaaaaatcttcaaccaaatactagcaaatcaaatccagctatattatagtatatatattcactataaccgagtgggatttatcctaggaatggaagtttgctttgacatctgaaaatcaatctatgtaacgcatcaaattaatacaacaaaggacaagaatacataatcatttcaatagatacagaataagtttttggcaaaattcaacattctttcatgataaaaacatccagccaactaggagtagaaagacaatctgccaacctgataaaaagcatcttcaaaaaccacacagctaacatacttcttggtgaaatactaaatgcttttcagaaaggtcaggtacaagatgatgtccactctcagtacttctctttaaccttgtactagaagttctagccagagcatttaagtaagagaaaggaataaaaggcatccagtttggggaaaaaaatgtaaaactctttctgtttgcatgatcttgtataagcatacttcattttactgtgcttcacagatactgcctttttttttttttcttttttaaacaaatggatggtttgtgg

SEQ ID NO: 413403 - DNA, 442 bp, Homo sapiens
ctcaaaactctttcatgagatccatgaggtcaaatcaattttcataataacaggaagactttatttgcctgtttcacttttattatgagtatatagtggagttttccagaggtgacacagtgtgggataccacaacaaattggatgcaggcgcatatgtgataatccacctaccttctgttaagccagatgttagagagacttacagaaatgttaaacagtgccatgcttctcactaattttgttatggaaaatagaacaattttttttaaatgtatgtatgttcgtatgtaataaatttatttttaactcacttaaaatatttgtttaaacttttattatggtaaatgtatatacaacacacataaacgaaaccttttggagttctcagtgtttcagagtataaaggaccttgagaccaaaacattcgagatgtgagtcag

SEQ ID NO: 413404 - DNA, 555 bp, Homo sapiens
aaccctacaaattaatacccacctcttggggcaaacccaatcagaagccaggcattgaaggagcctgggagagcagtctgcagggaaggcctcccaaggcataaaaagcaggattgaggaggggcagtgtggcaaaaggagaacagccagaatgccagatgccccttcggctggaaatgaggagaggggaggggactgaatacatggactgctctctcctcccacccaggcctcctcctgggcttccctgttacaggttgaattgtgtgcccccaaaattcatatgttgaagtcctaaccccagttagtaccttatttggaactagggtcattgcagatgtgattaaagtggggtcctactagagtaggggaggcccctaatccaacatgactggtgtccttataaaaggggaaatgtgggccgggcatggtggctcacatctgtaattccagcagtttgggaggccgaggtgggtggatcacctgaggtcaggagttcgagaccaacgtgaccaatatggtgaaaccctgtctctaataaaaatacaaaaatta

SEQ ID NO: 413405 - DNA, 530 bp, Homo sapiens
caattgcgttgtcattttaaccatactcatatttgtgtaaccaattaggaatataatcaaagtgaatatccatggaaccttgtaaaggcccatttacagggagctgttacatccaatgttacttttgatattaatgatttacaaagtaaaattctaacagcacctcaatatctttttcataattattggaataatgttactatgtttctgttttttgttcatagtctgtaaaatcaactggaacaccaaccagcaattgagagctgaacagcctgcaattacctttattcaattaaatcaaaagcagaaagggggagatgttggaggctgaaagaatgagggtcatgaccaactcagtataccactggaggctatgtgagcaaacagcaaactgttctcatgaatacaggatattggcaagctgacagctgcatctgccaccagaaggaatgctgaggacagtcatgcatcaggcacagtgttccttgtagttatctataggaacatctggaccctgttgtataaagaaa

SEQ ID NO: 413406 - DNA, 869 bp, Homo sapiens
ggagttttgctatgttgcccaggctggtcttgaactcatgaatctctttctctgcctatgcacaatcactcgttttctcctgcatgtgctctctctctctctttctctttctctctttaacaagttacagtacatcctggtctttctggtcctttttttttttttaacgaacttttcacttgtattaactctacaccagggtttcttagtgtggcactattgacattttggttgaggtcattatttgtcatgggttgctttcctgtgcattgtatatgtaacagcatccctggactctctctactagatgccaatagtgctccctcctccagttttggcaaccaaaatatctcttgtcattgtcaaatattccctgaggaataaaattatccagtgtttaaaaccagtggcctaccccgcttacaaaaatggctgctttcatttgatggcaataccactatttatttacctttctcctaataatagatatttaggatattcctagtcttttgctaccataaacaacatagcagtgtatagtagattcccattgtgtacatgtgagaacatttataggataactttctaaatatgaagtttctaggtcaaagtttatacatcttgaattttgattcagaactgtcaattgccttccaaataggatgtactgatttgcatggctggcaacattataatgccttttcctgtaaatgggaaatcacagtgtattatccgctgtgatttttgccattgtgagggagaaaagagtcgtgcattttaatttgtttttcttgatttgagtgtcttttttcatttttaaccaccatttgtacttttttctttcaaatatttattctagtcatttgccc

SEQ ID NO: 413407 - DNA, 678 bp, Homo sapiens
ggcactccaagctggaatggaaggaagggtgagtgagagcatgaagacgcatcgcctgtcttgggaacctcagttgcctggtgttcaagcaaaggatgaaggagagaaacatgtcaagaagggtctcattggggaatacgagtgttgtcttgtagtccatgaaaaaacaggcagttactaagccgagaattacctgaaacaattactctggcagcagtgaagaggatgaagggaagtgggagagactggaggaagggtagactgagagctgacagtatccagagaggagatgaagggcagtgacagaatgacatttatgactaggtagagggtggggacatttataaaatggccctgtggtttctagcttggtagagtggggaaatggtgagtcattagtcagtatgagaaataaacacagagagatggaacgaacaaaggaaagcaagagaaataagtttgtttgtatacaaggtccttctgagtcatgtgaagtagatggtatggattggatagggtgcttgttagaaaagtggagaatggcatgagagatttgggagcgtgtgagtaaaaccatgaggacataatccagctgtcagagctgagtggcaagtgtaaggcaggaaggtagcgtcagggcatagagatctctccttccagatgagtaagaaaaaaggg

SEQ ID NO: 413408 - DNA, 722 bp, Homo sapiens
cccagattgcaccactgtcctccagcctgggcaatagagcaagaccctttctcaaaaatgaaaaagaacattctggagagacagagaagcaagagggaccagaaaggtgcttgagatattttgcagaccctgcacttgatggatcagctggcaccacccagatcaataaactggctcatctgatcttgtggcccccacccagaactgactctgcaagaagacagctctgactcctgatgatttcatctctgaccaatctgcactcccagatcccagcactttgggaggaccagacaggcagatcacaaggtcaggatgagaggtgacagcgtgctggcagccctcactcactctgggcgcctcctcggcctccacgccaactctccctgcgcttgaggagcccttcagcccgccgctgcactgtgggagcccctctctgggctggccgaggcgggagccgctccctctgcttgccagaggtgtggagggagaggcgcggacgggaactggggctgcgggccacgctcgagggccagcatgagttccgggtgggcgtgggctcggtgggccccgcactcagagaggccggctggcgccattggccccaggcagtgaggggcttagcacccagaccagcagctgcagagggtgcgccaggtcccccagcagtgccagcccacaggtgcacttgaattctcgcaggcctcagctgcctccccacg

SEQ ID NO: 413409 - DNA, 870 bp, Homo sapiens
gacgataccagggtgaagatgcgcctcctgttgaacctagcacagcaggggcctgcttggccttgcctgaacacccaggctgccagaccatctgtggggtgtgggaaagagggcagcatctagggtcacggcctccctgagaggggcggcgcagctctgagaggaagagcataagctttatgtgtgggtggagctgaggctgcatgtgtcattttttatgtgcgtgtaggagacaaaggaaaagccaaatccaacttttcagatgcaacgttttctgtgacagtggcccctggactctgggacctgtcccaaccttgcactttaaggctccacccgcaccctactatgggctcgggctggtgcctggcatgatgaaacccaccaggatctgccactgtggcctgaacccagcctcattgcccagaccctaccgtgccccttaccccacctgccacgaaggctcagtcctccccagtgcaatgacccagccctgctggcttccctgtgtgcccttggagtgccctgtctcccagggttcatgctcagggtttgtttcagactcctgggtccagtcagcagcctctgcctgctaatggaacaagcacactgctctcctacctgtgaggtacttggggtgagaagtctcgtcacctcttttaagttagcagacgtgctggctttcccgggctcagacagcagagagacgtgcattgtgttttgttgtaatgcactgtgaacacctgggtgtgagggtgcacacccacagtcccactgactctggaagccgaggctggtggatcacctggtcctgggagtttgagtccagccttggtaacacagcaagaccgttgtctcttaaaaaaaaaaaaa

SEQ ID NO: 413410 - DNA, 450 bp, Homo sapiens
tgagacggagtatcgctctgtcgcccaggcgggagttcagggggggatctgtgggtcactggaagctctacctcccgagttcacgccattctcctggctcagcctcccagctactcgagaggctgaggcaggagaattgcttgaacccgggaggcaaagtttgcggtgagccaagatcgtaccactgcactccagtctgggcaacagagcaagactccatctcaaaaaaaataaaatgatacttagagatcaggactgagtgatgctttttgcccatcacattttcccatttgtcatcaagcatctaccttttcaaaaggtttaagctccccatcttgaagctggggctccacagccttggctgcctttacaggatgccctctcaggatcagggtcctgcttctgcatgttcctgtatgtgaagcagatggattctgtgagtggggctgg

SEQ ID NO: 413411 - DNA, 479 bp, Homo sapiens
atcagcagggagagcacgtgtgtttttatgaaaattatgccaagataggtaacagacgaggatgaaatttgggcttgactgaagtaatgggggctgcctgtgaagccttgcggcagtacagcccagggcttctgaggcaatcaggcagcgtcagtcttcagccgctaagccgagaagatctgggaaggagtcagtcagagagccttgggccagagttccagggtctctgggagtggctgccagagtcttactccgttgcccaggctggagtacaatggtgcgatctttgctcactgcaacatccacctcatgggctcaagcgattctcctgcctcagcctcctgagtagctgggactacagatgtaggcgaataacatgaacattgcttcatctttgttccacaagtttctgagacagcaccgacttcacacattcctgggctgttgccaacagtaggcctgaagaaccactcttgggg

SEQ ID NO: 413412 - DNA, 231 bp, Homo sapiens
ggcaagaacgcgatccgttcgcagcttccaggcaggtgatgaggatagctagtcccgcggtcctccgctagctggcggcgggggtcggccaggtgcccggaccctccgagggccccaccgccgcgcgtcccggggatcgggaccgctacccgcgcctcacctgcgcgcccgggccccagggccctgctcccgggcggtggcgcgggcctggctcccgtcgcagccacgacc

SEQ ID NO: 413413 - DNA, 737 bp, Homo sapiens
cgccagcctcctcgccagcaccatagagcgccttacaactaaataaagacccgagacctcgcgcaaaccagggtgctgccctttccaggaaacaggaatccattgtcaggccgtgatgcacgggatgtttcttttctctgtggtttcgctctcgttgtctacgtgaaaatgaacgagatgaacacacctgcgtgtgtgagactatcacggcaactgtgacacccaggcgttggcaatagagttggcagcctgatcctgggacaaaggtggtatggccgtagacaatggcagtggcgcctggctggcccaagagcccagtccagctacgcctgcctgattccaggcgtcaccaccaacccgggagcgcgaggctgggatcaggcaccccggagccgcttgcctgtggcccggctgctctccccctctacgcccaagcaccaccatcgccacgctgcgcttttcgccgacctcccagagcgtcccgatgtcgccggcggccagaccatgcgcgagacagcccaggcgccagaggcctccatcccctgccagggctctggactctccaggcggccaccctctcgctgagactccaggccttccccaggctcttgagctcccgagcttccaacacctggggcccgcttaggacggggtgtgctccgaggcgtcagggcccagggcccgcggtcctggggtcccctccggtcctccgccttgccgcggaaaaattattttgg

SEQ ID NO: 413414 - DNA, 905 bp, Homo sapiens
ctactttctggcactgtgatcttgggcaagtcacttaatcccctgaggctcagtctcttacctcatctggaactggggtgacagtgctccaccttctcccagcattgtgaggaggaagtgaggtgatagactgaaagcacaacccaggcctggcaatgagctgtaattatccccccacaatgtgagaaaagtgcttcatccaacctgtacttgaacccttgctgtatggtgggcccagcatgttgtgggggtccagctccatttgggtgcagctctcattattcagacttcttttctgtggagctaaaatcctgtgacttgcccatttgccgctggaattatctatatacagctaaagaaaaaggagataaaagctcatttcatttctctttgaaatcaatagtctcttagtctttcatgagtagctgagtaaaaagatgtctcagttaactatagtaaatcaaaagagcaccaaacagaaaaatagtggggctaggtgttagttctggccctgctattaagcggttttgcatggaacaagtcatgtcaaccctgtgggcctcattcacctcctctgcaggattctatagcagtgatgacaagtcagtgttgtctcatgttccatgtctgattgattgataatgatttcccacatgcagggttgaaagagaatctatggtgggtgctttctgaactaaatttttgatgtttgccaagaatatgggaggatgttttgggaggataaatgttatggcaacatttaagccacatattcaccattcctatactgagtagtctagggctaccctcagtttcaaatcctctttacataattgattatatcaacaaatatttacttagtatcttctatagactcaacattatgcttaagtaaacaacatcag

SEQ ID NO: 413415 - DNA, 723 bp, Homo sapiens
tagcagctggtaccggtctgggatttataggatcacagagagtgtgcagggtggtccttgtccctgcccaagctgcaagaggctctgcgaaggtccctcctgcccctgtccaccttgcacagtcctagccgggggaggaggggagaaatctggcgtgccaggagctggcaactgcccagcccttcctggatgtgggactgaggagtccgtcctgaaccgaagcatgatcctgttagctcttccagctctccaggcgccaacgaccatatggtctcggtaacgactgctccccacccgggctcaccttcagaccagcggcagcgctcacccaccacgcctgccagggaagctcagtcccaacagaatccagagagggcccaccacatgtgcctgcctgtgacggcctgtgacagggccccagccagggccaacgagctggaggggcccaaggagctcgggtgcagcgctggggtaacaggacagccccacggggtgctcccgagtctggaccagactcggggtggggaggcccagactcggcggggggcagacttggggtggggggattgctgggggaagttggggcctctggcaagggatagggcttgtgttcaagcccaaaggtgccccaggctgaaatgggcacccaggggtcactatcagagccccaacagctggccatgggggaagccatgcccagcaaacttggccctcgggaccatg

SEQ ID NO: 413416 - DNA, 844 bp, Homo sapiens
  misc_feature (8)..(8): n is a, c, g, or t
gaggctgngtacggtctgggatgtttgggattccaggttggcggttcctggggcggggccaggatagggcgatcctggaagctgggcttcggaagcgtgcagctgttgttccacaccagaaccaaatgagcgcaagatctgacaaaaaaaaaagtccctgtatcctgagatggagtcacctgagaatccacagcaagtcctaaccagggatgggtctgggtgattaaggaagattggcttcagaactgggccaggggcactgctttgcttttgctgttttgatcagctctctgcctgcaggagacgaggaaaaccaatgggaacagatagggtctctctctctgccactcaggccagagtgcagttgacgcagagcatggggagccctgaaatggagcatagtgtgtccggaactggtgggttcttggtctcactgacttcaagaatgaagctgcggaccctcgggaaactcctggagggcagaggcatgcctgccatcttcatcattgcattaccatcacccaacactatcagggaacctgccctgataatcagtctacagttgtatccagcagctccagagagacagcgaccagcaagaaggggccatgatgatggtggtggttttttcaaaacgaaaagggggatatgtagggaaacagaaagagagatcagactcttacagactcttactgtgtctacatagaaagggaagacttaagagactccatttggaaaaaagaccttgtactttaaacaattggctttgctgagaatgttgtaatcttgtagcttttgccccgagcatttgccccaaccactttgacccaatctggagctcaca

SEQ ID NO: 413417 - DNA, 710 bp, Homo sapiens
aactccatctcaaaaaaaagaatcttttatctgaagattgtaacatccatcagtggtcattgcttgggtcagttaccattataggttggaaaatggtgacttgtgattttgtcagtttttttctttgcaagtgtcgtgtatgttggaattttatgaggctgggtcctaggccctcatttatcctcaaagatcacatatttctcccaggccctctctcctgagacagaaatgtgctcttcttcctagggtactggctacttcatactcccttctcacccagatccagaaatctcggtcgcagccccttctccctctgtcccaggagtccagacccccagctcctcctccctcaaacccagaagtccagacccccagatcctccttccttagatccaggaatccaggccccagcccctcctccctctgacccaggagtctggctgacctcagcaactcccttctccacactgtttgtcttgctgtccctttggtcaccaggccagagtcctggactttgccctgtacacttccctgtctctcacctccaagcccgtcaaccaccatgtcctatcctttctgcttcctgatcctctctgtctagtccatctatttttcagccccaccgcccaggccccagcttaggtctcaccctcattgcttggaggactcccgaggcagctgctctccacccctgtaacccatctcccaga

SEQ ID NO: 413418 - DNA, 935 bp, Homo sapiens
gctcctgggcagagggctgccttctgtgtgggcttgcccctcgccacacctggccaggagcctcccccagccccgtgacccttgtgtcagagcctggccagatgacagacggcctggggtgcaggcgagacccactgaactggcagctgaggacaggtccaggcccagtggctgggggacttctcagagcaggtaccacaacagctacccaaggactcaggacttttctcccacagccagacttggtgattgcatgaaggagcccagcctcggatgacctttccccgtgacaaggcactaggagagcacagacctccccacacaaacagtaagtcagcatgtggttaaaaatgtaaatatgcactacagagtttaaaatatatcaaccgaaggagtaaaaccagactgtctgcttgtcttggattcattttgtgctgtacaaggctcaaaaggaacccaaattctggctaaagaggccttttatgggaggccccgccttgacggtgacaggttgagacctattgcaaacccgtggtggcctcacccaccaatttcctctgcagcttcttccccctccatgctccaggctggccagcaagcaggccgggggccaggggcacactagctccaggcgtgacagccagatgcttcctgcaccaccaggcctgctccgaggctgcatcccagaagccactccaggcaggcagggtttcttcccaacatcttgggaaacagaacttacacattacccccagcacacacacagtacctagaacactctggcttcaatgccacgcccatctctgtctgtgtctacactgtttggggttgattgataaggccccaaatgcattcccaccaagagctcgttttgcagacttatcatatcacaccacgccaggggcacgtgcacgttttagaacatggtatcctag

SEQ ID NO: 413419 - DNA, 907 bp, Homo sapiens
gagctgaatgcagccgaggggcgagcgcgcgggctcgcacggattagccgtgctttcccatgagccacaaaagaatgcccgaatctgggacatctgtcatcaaggggcaggctgctcaggatgcaagatattgtcaagaaccctctgctctacagttctttgctgttcttgacccacctccttcaaactcggattttccgtttctctcttctcctaagagctgcctgctgccttctgaagctgctttagaaccacagaagcctggatcatctctacaaagggtgcaagatgaaggtgttaggacaacttaaagagacgggaggtgctaggaatcggcaggtgcctgattgccaaggcagggactgatggtgggagatgttgttacagaactgggcttcctgatagcaatgaggatgaaaagattccaaaacaatagatttaaccagcagaatcaagtttctccaggacaagagaaaaagagaatcctgaaggcatggttcccagacggggtgaaatagttaatacagaaattcttctaactcaggcccaaacatctccacactgtccccatcctcaagccctgctgtccaccccacccctatttgtacaggagccatttaatagagcaaacagtattcgtttggcagtttatttgtgctgcaccaaaaaaaaaaaacagagaagccaaaacagaaagaaacaggaaaaacaaaaaaccagaaatggagaagtgttccctttccagacaatcatatgaaaaccttgacaccgagagattaagtaatttgcccaaggtcacagttttaagtgcagagcttggacttgaacccaggcaagagaagaagattccatgaagctcacattccaacattggagacagcatggagctgtcagtgacctccccact

SEQ ID NO: 413420 - DNA, 770 bp, Homo sapiens
ggaaagaaagcctccaagagagtggtgattctacaaccatcatcaaattttggttgaaaactcaaagctgctgatatgtattagtaagcagataacagtaacatcctgtatttgcatggccctgtatcagtcaatagcattcagatttgtgtggtggtgtatagctttccttatttcatatcaggtgttttcatttgatcccaagtggtatgtcctgagacagaagaaatagccccattttacagaagaagaaacccaaaattgcaaggaatttgcctaaggtcattagaaagtgtctaaaataagactttgacccggactctctgatttcaagcccagcgattcttctaacaggccatattctttcacttttattatcttgacttacgcaacaaaggagataagccaggtacatgtcattaatcttcctatgtatgacaactgaggctccaggaggttaagtgccttgcctaagattacttgggtggtggtagaactggttttcaaaaccagatcatctgaatggaatctaagtctttcttctgtatcaccttgttaatgtgtcaggaactaccaccccaccttccaaaacacatacacactctcacttttaatgcggacccatcttagaataaactagttaaggactgactgctgaacatggtccagaaacttactgtcaaattttgcttttgagatgtgcttgtgttgtgtgaagtctttttttttttttttcagtattgatgagggatcactttaagatttattgg

SEQ ID NO: 413421 - DNA, 893 bp, Homo sapiens
caaggaagaggtcaaatcaggcaaagacccgaggatcaggcagcactagatagggaccagtgtgtggggtgcaagaagaaaggacactggaagaatgaatgtccagagggtgatgagggagaggtggaagtaggggcctaaggggccataactttaagcctgccaccatcctgaatatatggtgttaactcttgatgtcccacaggtggaagaatggaggctgtatgcagaagggttgtcaaagctggggctagatgagctgtatgggtgcctagtaaaattcgtagagtgtgggctgaagataatgcccctaccctcgctgtgaaccagatacaaaagatagtagaactaaaatcaggagaaacactggttcggtttcgttattacccacttccctgagaagcaatacatggcattcaagggcatttgaagtggcaattagaacacaggatcttggcccgatgacagtcactgtagaacactctccttttgccagtgcagaaactggggactaatgaatatagactggtgcaggacctacctgttgcaaaccaagcccctgaggattcaggaagtggaagctacacatagcttactggctgcaaagctaaggaaaagtggagcacatgaactggacactccagcagctattaaagaaatattgccaagaaacacatctaagatgggatcagatcctgcccatggtcctcctctgaatcaggtgcacttgcaccaaactgggtattcgccctatgagatcttgttcggccggccactcccaatcataggtcaaattaagggtgatctctgtgagctaggagaattgtccttaagaaggcaaatgcaggccttagggaaagccatgcaagaagtccatggctgggtatgggaaa

SEQ ID NO: 413422 - DNA, 631 bp, Homo sapiens
gggtgcggtcggggacccggcaggaggcggcgagaagagaggaccgtgggggcgttcgcgtggctcccagcccgggaccccacccccgctggacagtgggggaaactgagtgcctgagcctgggcccacacaggaccatgaaggtgcttctcctcacagggctgggggccctgttcttcgcctattattgggatgacaacttcgacccaggtgagcacctggggttgagggagggagaaaccgggccagctgtcctgtcctccgcccagagtgaccaccccggctatggccagccagcctccagggagcgcgagtgctgctgacaggggccaacgctggtgttggtgaggagctggcctatcactacgcgcgtctgggctcccacctggtgctcactgcccacactgaggctctcctgcagaaggtggtagggaactgccggaagctgggcgcccccaaggtcttctacatcgcggcggacatggcctcccctgaggcgcccgagagcgtggtgcagtttgcgctggacaagctgggcgggctggactacctcgtgctgaaccacatcggcggggccccggccggcacgcgagcccccagcccccaggcaactcgctggctcatgcaggtg

SEQ ID NO: 413423 - DNA, 878 bp, Homo sapiens
ggaagccatccccaggtgcctaccatgcagacccaggccttggcactttgagtctcctgacaggcccttgcgtagccacggcccctcctcctacagagattcaaagcattgcagcccctttcctccaaaaggactgcagtcctgagaccctagcgtgtggctccaaaaacgcactcacacctgcaacccccagaacagcgcgtgagccctggctgtgggggagcagcctcgtgccgggccgtgtgctcagtgtgctcagtgaagtgcgtgcacagccactccccctcctcccccagagcagaggctccttctccccggcacagatctgggaatgtggggagggacaagccccatgtgctgggctccctgctggaaaggaatggttgagccgccagtgtgaggtgctgcagagccctgttggcttgccaggtgatgggcagagggccctgggcttgggtcctgcccacccactggtggcacctccccagacccactctcatctgggtctgtggcggcggaaggagcgagagatcccagcactaaactctccctcgctctgtttttttgaggaacctgaatgaacctgaaagcaaagaccgagtggagacgctcaggtgagagggctggagccagcactggccctgccctgggcaccgggctttgccacagcctcctgctcctctcttccttctgccacttggctcttcctcccgtggttctgccctgtaccctaccctctggggcctccctttcctcagagagtttccccttcccaaaccccaattgcaggagtacgggcccttctcctcaggtctggtatattctgggaagttcgggaggttctggagtcgggcaggatggggctacagattcctacc

SEQ ID NO: 413424 - DNA, 811 bp, Homo sapiens
tcagcgtccaccgtctgctgcctacatccgcccgcccggcgtccgaccccttcagcggcgacgggcggagctggagccccgggcctgggcgccaggtgggctcctgggagggtgatgaagcagatgaggaaactgaagttcccaagagccaggtagcagacacaaacaccccttggccacctttttccacctgtttttccgagtgagtgccatcgtcacctacgtgagctgcgactggttcagcaagagctttgtgggctgttttgtcatggtgctgctcctcctgtccctggacttctggtctgtgaagaatgtaaccggaagactcctggtgggccttcgatggtggaaccagatagatgaagatgggaagagccactggatctttgaagccaggaaggtctctccgaatagcattgctgccacagaagctgaagcacgaatcttctggctgggcctcataatctgccccatgatatggattgtgtttttttttagcaccttattttccttgaagctaaagtggctggctctggtggttgctgggatctctctccaagctgcaaacctgtatggctacatcctttgtaagatgggaggcaacagtgacattggcaaggtcacagccagtttcctgtcccagacagtgttccagacggcctgcccaggtgactttcagaagcctggcctcgaggggctggagattcaccagcattagatgtttcccctgacaaacgtcctgcccaccaatcccatctcggcagagctgaactgtggcagaggtgcaggctggcaggaatggatgtgccct

SEQ ID NO: 413425 - DNA, 352 bp, Homo sapiens
ggaaaagcccctctcaggaggcaatacatattctgtgacctattgataagaagaaagcagccttgaaagatctggaggaagacagcattccaggtggagggaactgcaaattcaaattctctgagggaggaatacaattgcctttaggaggaatatataagaagtcagtgtgtctggagcataaattagaggcagaggggagacgtactaggtgagaccagaccagagaatttggtcaggtataaaaagaaaacagggaagtattcttcccccattctcccaattggagtaaaattttctagaaggaactaggactattctccctctctctctctttttttttttttttttt

SEQ ID NO: 413426 - DNA, 757 bp, Homo sapiens
ctcaaagaaaaaaagttcaatacaatatattttattcttcttttactttatgatttttaagaaacattttccctactccaaagtataaatatttttctatgtgaattactataagttttgatttttgcctttcatatttgggtctacattctatgtggaattgatttttttctttttttgtatgtgatgtgaggaatatattctcttaatagataagaaattgtgcaatcatcaaatattgacaatcgcattgtttcgtgactgctcttctgtgcctaatttgtcataaatcaactgttcatataagtttttaagtctgcttcaggattctctgttctgtcgcattagtttgtttgcaaattacattgtgatttccaaattaacttcgcctttctggaataaattcaacttgatcatggtatgctgtctttttggtatgttgctgaattctttttacactaagaattctgcatttgtgttcatatatgaagctggcctgttatttttattttcttgtgaaatttgatatcagggttatgcttaccacataattcatacagagtgtttgttacactggcattatttcttccttgggagaattcactggcaaagccatctgaccctggacttttctttgtgtgaggttattcattatagatttaattctttatagattgtaaaactattcaggttgtctattgtgcctttgtcagttttggaaagttgtatttttctattaatctgtccattttatcta

SEQ ID NO: 413427 - DNA, 749 bp, Homo sapiens
ctgttcaaaagcattttattttgcacaaatcaattcagtaatcccaagtgggtgggacctggataggcatctaaactgtatcttttgcggactgcttttttctttttaaaatattgtggtgataaacagagaagatatttgcaccttgctagttatgttcccttcctgcctccctctacttctcttatttgaaactggaattcaatttcagaagggaaattttgtgcactaaacagaacggacctgagcagccacagcaaaactctcacatgcccctcctcctctggctgccttctgttggaaaagccactcctctttgatcttaaatcactttaaatctttcataaaagcttctttatctatacacacacacacacacacacacacacacaaacctgagatttttaggggacagagaagagttgagtggttcatgacactcttcctttccccttttacgttggttacttggacatggctcaattttggagaaagagggagaagtataagggttcatggggtactaggagcttgcttggccactcaccagggaatctcctccccaaaggattaaggtctgacaagactgaggctctccttcaaaacagtctgttgactaaagattaaaacatttatgtgtgagctaaataaaaagggaggcatgtgtgcatgtgtatgagaaaacacttctaccaatcttcatccaacccttggtttcctctcaattctaatgggattttctaggccca

SEQ ID NO: 413428 - DNA, 464 bp, Homo sapiens
tcctcttccccctgccaggcctcagtttccccatctataaagttatctgtcatcctccaagaccctgcctgtgggagagggggaggtgccttctgtggccacttctttcctctgtcagcctgagggatacacctgtcctaacatgttggtgcaggccccttcctggacacctgcactgcatgcatttgggggtcaagtattcccccaggataggaccctgacctggggaggcttcccagcccacgagccttggcaggcaggtcctgagggcagcgctgagcatctaacctggctcacctcccaggcccaagaatgggcagagtctgcctctggagcctggcagagcttagtgtctgtgcaggccccagggggcccaggcaagggacccattgtgcagggaccaggggcctgggccacaaagcaggacctgtcctcctgctgaccctgccctggctgcctgggaa

SEQ ID NO: 413429 - DNA, 1618 bp, Homo sapiens
ggcacgaggattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaactgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaagccaaaaga

SEQ ID NO: 413430 - DNA, 3885 bp, Homo sapiens
ggcacgaggattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacagcttcacctggctctgcggacacgtgcaccggaacatcctctccaagttcacaggccaggcggtggagctgtttgacgaggagttccgccacctctacgcctcctccaagcctgtgatgggcctgaagtccccgcggctggtcgcccccgtcccgcccggagcagccccggccaatggccgccttagcagcagcagtggctccgccagtgaccgcacgtcctccaaccccttcagcggccgctcggcaggcagccaccccggtacccgaagtgtgtccgcgtcttcagggccctgtagccccgcggccccacacccgcctccaccgccccggttccagccccaccaaggcccttggggagccccgagtccccaggcccacctctccccgcggccccacgacggcccgcccgccgctgtctacagcaacctgggggcctacaggcccacgcggctgcagctggagcagctgggcctggtgccgaggctgactccaacctggaggcccttcctgcaggcctcccctcacttctgaaggtcccatcccctgctgccctccgcaggcccagggctgggcactccctgagacccaaagacccacctcaacgacgagtggcgttgagccacttccctttgaaaagacactcaaaatcactgccatggttcaatgttcccaggccccaggccatccacttgccggcccccaccagttcttgggttccccgctctagtttgacctgtgcagcacattccagaaggttccagggaggttgtggggcagctagaggacaaaatcatgaaaacagagtccctgtcttccagagatcatccggggctttaatattaatggcccccaaaactccgtaagaagcaggaaatgcagcccaagttttacaaatgggtaaacagaggcactgagagatagatggtagtttggtacttctggttcccagtgcccaggaatggtccactcccaagaaattcaggaaagaaagactgaggagaaggtgtgggaacattctggatgtttcgggagagttggggaaactcctcctcttaggaaaggctaatactagggtatccttgggcccaatgaattaggggtgaggccccagaacccgttatctatgagttgtatgggggagccatctgaagctgtagccaccagggatgcagctagctgaggagtttggggtgttgggttggacaaggcaggttagtagactcagattcttgcttcaaagagccttgggctggcctggaggtccctggagtctagactggacctaggagcttgagttgtcaggggccaggactggccccactgcagtgcccaggccagtcttgagcagcagggagggctcagctgtccccagatccaggtgcctctgaccagcctggtcacctcctgaggaataaatgctgaacctcacaagccccatcattcatttcttctcaattcacagtgcccctctttgtttctggggtggaactaggtcctgagggcacagcctagctgagtgcaaagaaatataggatgcttagaaagcatacaggaggggccaggcgtggtggctcatgcctgtaatcccagaactttgggatgccaaggtggttggattacctgagatcaggtggattacctggtctcgagaccagcctgaccaatatggtgaaaccccgtctctactaaaaatacaaaaattaggctgagacaggagaattgcttgaacccaggaagcagaggttgcaatgagctgagattgcatcactgcactccagcatgggcaacaaagcaagactccgtcacagaaaaaaaaaaaaaaaagagagagagcatagaggagggttggccagccctgtggtgggtgggatgtcagagacacttcccagataaagtaagagttaaccctgcacctcaggtgtgatagtggggtcagtggtatgtgatccaggctggggagccagaggggagcaggtgccaactccacatccttctcctgtttctaggccctctcctcccttgtcggtttttggcggggaagctcagccttcgctgtggagggacgagagcacagagctcttcctcctggtggcctctgacccctgacggcctgtggcatcctccctagtcccctctgcccatccatccctctgttccaattctccactgctcccagcatgatctggggcatcttggcttctggtttcttttattattattattattattaattattgtattcctgtccttcacttttttcctccttagttcctgaaagtaaacaaaacaaaacaaaaacaaaaaaacaaacaacactttggttcctgatggctttctgaacccagccctgaccttgttgtttcacagctgacggctgagatgaggttagaatgactgggcccggctgaacattccaaattggatttcaccatctgctgagaaagtttaaggaaggcaaagcttgccaggtcacagaagctcccaagcccagctttccaaaggcctcagcctgtgcctgtgtcgagctcagtcctgggagataggggagaacctgcaggcaggaacaagcccccctactcctgaccaccctccatcagcagtctcccctccgtggtcgtctttgttgacaaaggtgcagtttctcctctcctgggcacctgtaacatgtgatgcgctgcctgctgggaggttaggtcggggctgccccggcgagtggagcatgagcagaaccgccgagggtcacttctgggcagaagctttgagagcctgggtccaggttgccacatagaagcagctctccagttgaaaccctcctctgccagcctggggtcctaagcgatgagcagaatcccccactcccaccccaccaacccacaatggatatgtagtgagcaagaaataaacctttgttgtttaagccaaaaga

SEQ ID NO: 413431 - DNA, 1303 bp, Homo sapiens
ggcacgaggattgctcaggacagcggtaaatcacttcttggaggtgccctgcacgccggtcctgggagcaggcggcctcccgggggtgcgggagccccactcctccgtggtgtgttccatttgcttcccacatctggaggagctgacgtgccagcctcccccagcaccacccagggacgggaggcatgagccggtcaaggcacctgggcaaaatccggaagcgtctggaagatgtcaagagccagtgggtccggccagccagggctgactttagtgacaacgagagtgcccggctggccacggacgccctcttggatgggggttctgaagcctactggcgggtgctcagccaggaaggcgaggtggacttcttgtcctcggtggaggcccagtacatccaggcccaggccagggagcccccgtgtcccccagacaccctgggaggggcggaagcaggccctaagggactggactccagctccctacagtccggcacctacttccctgtggcctcagagggcagcgagccggccctactgcacagctgggcctcagctgagaagccctacctgaaggaaaaatccagcgccactgtgtacttccagaccgtcaagcacaacaacatcagagacctcgtccgccgctgcatcacccggactagccaggtcctggtcatcctgatggatgtgttcacggatgtggagatcttctgtgacattctagaggcagccaacaagcgtggggtgttcgtttgtgtgctcctggaccagggaggtgtgaagctcttccaggagatgtgtgacaaagtccagatctctgacagtcacctcaagaacatttccatccggagtgtggaaggagagatatactgtgccaagtcaggcaggaaattcgctggccaaatccgggagaagttcatcatctcggactggagatttgtcctgtctggatcttacaggtggcagcttccagatcattgcctcagagacctctgatcaccaccccgagccctcttatcctctatggcttcactcccatcatgatttggaattatttatttgtgaacttgattagccgagattgtaaatgacatgaggtcagggactggactgggtatgttttcttctctgttgctttcctggcatgaagtacagtaaatacagcacctgatacattatacatggccacaaatatttgttgaatgaatgaataaaagcacattgggttctgaccattcagtgtcctgaaagaatgcagtttttcaaactgtgcctcaccatccattagcggggtgtgaaatcaa

SEQ ID NO: 413432 - DNA, 454 bp, Homo sapiens
tgacggcagtgcacgcttgatgcctgttggtcgtatctagagtgtatcccccacatacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 413433 - DNA, 264 bp, Homo sapiens
gctatatgtttgcctctagaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaaggacctggccaagacagagggaagaaggtgtagccaggacagcggggctccgggggagg

SEQ ID NO: 413434 - DNA, 1380 bp, Homo sapiens
cgagaccgcggacgtctgtaatctcagaggcttgtttgctgagggtgcctgcgcagctgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 413435 - DNA, 1513 bp, Homo sapiens
cgagaccgcggacgtctgtaatctcagaggcttgtttgctgagggtgcctgcgcagctgcgacggctgctggtgagcgcccccgaccagaccgagggacagggcgaagggggactggaggagggaacccccctttagggacactgagaggaggcgggcgcttctgggagtgagagcttctgcccggagctctgccagcctcgaggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttggtgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 413436 - DNA, 823 bp, Homo sapiens
atagcattttatttcatgggacgatttataagggtgttgatttggaatcctaggttgcaaattgctgagtgtttcggttctagaactaatgttccccaggaggtagatggtagtgatcaagtctctccccctttaactttaaaaggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaa

SEQ ID NO: 413437 - DNA, 541 bp, Homo sapiens
ctttttaggattggtctaatcagatactcatttcttttctctttctaggttttgaaacatgaatctttcgctcgtcctggctgccttttgcttgggaatagcctccgctgttccaaaatttgaccaaaatttggatacaaagtggtaccagtggaaggcaacacacagaagattatatggcgcggttggtaacatctgaaactgtccagagggactctggagagaatggtcctcgctgttgggagttgatagccagagagtagcttctagacaccagaccttaccaggcaataacctaacagcacccattataggtgcaatatgggcatatatctccattgtgtcttggcttggagaacagctcccagagaagtatcaacccatccctggccatggtttctcttccatttctgcccgcaaatcggcttggtgaacatgggttgggtaagtagacataaagtccaccagctatatgtttgcctctagaatgaagaaggatggaggagagcagtgtgggaaaagaatatgaaaatgattgaac

SEQ ID NO: 413438 - DNA, 479 bp, Homo sapiens
taagtattagctattattattaatggagccaattttcccttgattccttgtataaaatggaaaacctgctcctctttcagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagtttgaaataaattttaattcgtatataaaggtgg

SEQ ID NO: 413439 - DNA, 189 bp, Homo sapiens
gatctaaaaatcaatgagaacataattttaattggcagttcttcagaaaaatgtgaatggcttataaacataaatgtaatactcagctgctgtcatcatcagaagaatgaagttgtttttaagctcttcaactgtcaagagtaagaagcaatgttactaataccggcaagatatgaaaagacgctcata

SEQ ID NO: 413440 - DNA, 854 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagagtcatcctagggcatccagaggccttcagggtggcctgaagtctcccaccgcaccacctttgggttaacctagcctgtcccacagaagatgatgaagttgggtctggaggcaagctgactcagatggattctcgattttatgatgctggactggagatgggtttcaccatgttgcccaagctagtctcgaactcgtggactcaagcaatccacctgcctcagcctcccaaagtgccttacaggcgtgagccaccgcacctggctgaactgtcccttcacacttaccttcagtcctggagggaggacctcttgcttgtggatctggatgacagtgatactcacaagtaccacaatactcacaagcaagaccaccaaggcaatgatggttggagttcggtagagggccttgaggcctaaaatgagaagacccagaagacacttgagggggaggtaaaaaccaggcactggtattctttgtagaattgatggacttggccccataatcaggtgcataaaccaccttctctggtgttagcgagacccacacttctaagatggagtagcaaataagctccccttctccccag

SEQ ID NO: 413441 - DNA, 1142 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagagtcatcctagggcatccagaggccttcagggtggcctgaagtctcccaccgcaccacctttgggttaacctagcctgtcccacagaagatgatgaagttgggtctggaggcaagctgactcagatggattctcgattttatgatgctggactggagatgggtttcaccatgttgcccaagctagtctcgaactcgtggactcaagcaatccacctgcctcagcctcccaaagtgccttacaggcgtgagccaccgcacctggctgaactggtaaatctttgatagctatctgcaactcttggttacaaattttagctttgaagtcagaagtcaaagcaagactacacagtccttggagaaggtgtcagtcactaccctcaatttgtagcctcaaatatcacaaacccagcatgtccagaccttctcccttgcgtcttacactaacttctcctggcttcagccagagatggggggaaaggattttctgctcttctaactcatggttttggaataattgatttcttcccctttatgctcatttcttccctttgttgccagtcccttcacacttaccttcagtcctggagggaggacctcttgcttgtggatctggatgacagtgatactcacaagtaccacaatactcacaagcaagaccaccaaggcaatgatggttggagttcggtagagggccttgaggcctaaaatgagaagacccagaagacacttgagggggaggtaaaaaccaggcactggtattctttgtagaattgatggacttggccccataatcaggtgcataaaccaccttctctggtgttagcgagacccacacttctaagatggagtagcaaataagctccccttctccccag

SEQ ID NO: 413442 - DNA, 1533 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagcaagctgccctgttgtgagctctccggtggagagccccacatggcaagaaaatgagaagccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtcacaaagttttgaggtatttgttaatacagcaatggatacttaatacagcttcctacatggtctccctccttcgacctttacactacaatctgtcgtccacacagcagtcagagatccttttaaaacataagtcagatcatcatgacactcacctccctgctaagtgtcctgcaaggcctttcacggtctgatcccctatcctttctctttcctcatctcctatcactcttgcccttgcaaattttcttccagcactctggcctccttgctgttcttcagtatggcaagcaacctgctgcccggagcccacacactgactgtcccctctcctaggacactcttccctcaagggctcccatatcttgcctgctggctcctgcatcttcttcaagtctgctcaaatgtcaccttctcagtgaggcccatcctggctatcctctttcagttctgacagaaaataatttattgctttattacatcattattttgttgtcttccctccgtctgttcctactaaaatttaatctctgagaaagcagaaaacgttgtcttgttctttcctgtaacccaagtgccttgaacattgcctcattaattgcttgcgctcagtaatatgtgttgaataaatgggttaagtagtttattaattgtgaaactaaatcctgtctgaaaggtttggagcagcttgttgaaatagcaaatggagattctgtgttttaagttgtggctaaggtagaatcatccatgatgtatgtggagccagctcctgtgtcctggacttaaacatctgtatctgacgtgtgggtaattatattgctatcctacacctttgacccattcatctcggctcacctgtgatccaggctatgctactaaagttgggtgagagagtctgcaacacaaggaaaacatagagccatcatttagtaaatcaaacccataataatacattttgttgttaaatgt

SEQ ID NO: 413443 - DNA, 1583 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagcaagctgccctgttgtgagctctccggtggagagccccacatggcaagaaaatgagaagccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtcacaaagttttgaggtatttgttaatacagcaatggatacttaatacagcttcctacatggtctccctccttcgacctttacactacaatctgtcgtccacacagcagtcagagatccttttaaaacataagtcagatcatcatgacactcacctccctgctaagtgtcctgcaaggcctttcacggtctgatcccctatcctttctctttcctcatctcctatcactcttgcccttgcaaattttcttccagcactctggcctccttgctgttcttcagtatggcaagcaacctgctgcccggagcccacacactgactgtcccctctcctaggacactcttccctcaagggctcccatatcttgcctgctggctcctgcatcttcttcaagtctgctcaaatgtcaccttctcagtgaggcccatcctggctatcctctttcagttctgacagaaaataatttattgctttattacatcattattttgttgtcttccctccgtctgttcctactaaaatttaatctctgagaaagcagaaaacgttgtcttgttctttcctgtaacccaagtgccttgaacattgcctcattaattgcttgcgctcagtaatatgtgttgaataaatgggttaagtagtttattaattgtgaaactaaatcctgtctgaaaggtttggagcagcttgttgaaatagcaaatggagattctgtgttttaagttgtggctaaggtagaatcatccatgatgtatgtggagccagctcctgtgtcctggacttaaacatctgtatctgacgtgtgggtaattatattgctatcctacacctttgacccattcatctcggctcacctgtgatccaggctatgctactaaagttgggtgagagagtctgcaacacaaggaaaacatagagccatcatttagtaaatcaaacccataataatacattttgttgttaaatgtagccaatctctgagtattttttattaaagtatctctaatgtttaaaaaca

SEQ ID NO: 413444 - DNA, 1100 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagcaagctgccctgttgtgagctctccggtggagagccccacatggcaagaaaatgagaagccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtcacaaagttttgaggtatttgttaatacagcaatggatacttaatacagcttcctacatggtctccctccttcgacctttacactacaatctgtcgtccacacagcagtcagagatccttttaaaacataagtcagatcatcatgacactcacctccctgctaagtgtcctgcaaggcctttcacggtctgatcccctatcctttctctttcctcatctcctatcactcttgcccttgcaaattttcttccagcactctggcctccttgctgttcttcagtatggcaagcaacctgctgcccggagcccacacactgactgtcccctctcctaggacactcttccctcaagggctcccatatcttgcctgctggctcctgcatcttcttcaagtctgctcaaatgtcaccttctcagtgaggcccatcctggctatcctctttcagttctgacagaaaataatttattgctttattacatcattattttgttgtcttccctccgtctgttcctactaaaatttaatctctgaga

SEQ ID NO: 413445 - DNA, 864 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggaatgctgatggtatagcaagaaggtattctgagcattatatcaatggggaagttatagatcttttgcaaagcaggagagtcatcctagggcatccagaggccttcagggtggcctgaagtctcccaccgcaccacctttgggttaacctagcctgtcccacagaagatgatgaagttgggtctggaggcaagctgactcagatggattctcgattttatgatgctggactggagatgggtttcaccatgttgcccaagctagtctcgaactcgtggactcaagcaatccacctgcctcagcctcccaaagtgccttacaggcgtgagccaccgcacctggctgaactgcacagtgaacatcttttctcctagctgcaggtgagagaatacaggatgtcagtaagtccaccgccccggcctcacaagtttaaagaacgagcccaggttaagacaaaacccattttacttcctccaaatcaaaacctcatcccgggaaaggtaagccgaaccccagaacttcagagacagccccaaagctggagcttaaatttcatgtcatctccccaaatgaaaggaaatgaaaaatggatttgctgaaacttcaaactgaaaaggttttccgaaaaaaggtctttttctgcagattgttccacctgtacacacacccaagagaga

SEQ ID NO: 413446 - DNA, 1162 bp, Homo sapiens
aggaatcaagatggccgcctgggaccgctctcagccccttcggcctctacctgaagagccacgccccgtctgctacacccaaccgattggttcctcaatcacagagaggagaggcaacatgaggatgacgtcagatacaaatatggcgttttggacgggctcgatagtttgcttggcctctactcaaggctggagtgcagtggcacaatctcagctcactgcaagctccgcttcccgggttcaagtcattctcctgcctcagcctcccgagtagctgggactacagagtcatcctagggcatccagaggccttcagggtggcctgaagtctcccaccgcaccacctttgggttaacctagcctgtcccacagaagatgatgaagttgggtctggaggcaagctgactcagatggattctcgattttatgatgctggactggagatgggtttcaccatgttgcccaagctagtctcgaactcgtggactcaagcaatccacctgcctcagcctcccaaagtgccttacaggcgtgagccaccgcacctggctgaactggtaaatctttgatagctatctgcaactcttggttacaaattttagctttgaagtcagaagtcaaagcaagactacacagtccttggagaaggtgtcagtcactaccctcaatttgtagcctcaaatatcacaaacccagcatgtccagaccttctcccttgcgtcttacactaacttctcctggcttcagccagagatggggggaaaggattttctgctcttctaactcatggttttggaataattgatttcttcccctttatgctcatttcttccctttgttgccagtcccttcacacttaccttcagtcctggagggaggacctcttgcttgtggatctggatgacagtgatactcacaagtaccacaatactcacaagcaagaccaccaaggcaatgatggttggagttcggtagagggccttgaggcctaaaatgagaagacccagaagacacttgagggggaggtaaaaaccaggcactggtattctttgtagaattgatggacttggccccataatcaggtgcataaaccaccttctctggtgttagcgagacccacacttctaagatggagtagcaaataagctccccttctccccag

SEQ ID NO: 413447 - DNA, 377 bp, Homo sapiens
cacctctgtttgtctctctgtttttctttctctttctctgcctccctctcttttctgtttgcttgctgtgatgaagcaagctgccctgttgtgagctctccggtggagagccccacatggcaagaaaatgagaagccccctgaacagacaagagctgaggcccaggatacaatatcctgaaaaaaactgaatcctgctgacagttgcccaagtgaagctggaagtggatctttctgcagtggatccttgagatgactgtagccctggctgacaacttgattgctgcctgtgaaggaccctgaaccagaggactcagcgaaattgtgcccagattcctgacctacagaggcagtgagataataaatgctgttgaggtc

SEQ ID NO: 413448 - DNA, 574 bp, Homo sapiens
aaggacccagggtacacagggtgggtggctattctccagaaatgtcagtttctgggcagggcttaggtgtctgcagtccctagtcccacccctggccttgcattccagctcagcgggtggaaggtataaatttcagctgctctcagccctgctgtgtttttccaaagccttccaacagcaacatgaagttggcagccttcctcctcctgtgatcctcatcatcttcagcctagaggtacaagagcttcaggctgcaggagaccggcttttgggtacctgcgtcgagctctgcacaggtgactgggactgcaaccccggagaccactgtgtcagcaatgggtgtggccatgagtgtgttgcagggtaaggacagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413449 - DNA, 722 bp, Homo sapiens
aaggacccagggtacacagggtgggtggctattctccagaaatgtcagtttctgggcagggcttaggtgtctgcagtccctagtcccacccctggccttgcattccagctcagcgggtggaaggtataaatttcagctgctctcagccctgctgtgtttttccaaagccttccaacagcaacatgaagttggcagccttcctcctcctgtgatcctcatcatcttcagcctagaggtacaagagcttcaggctgcaggagaccggcttttgggtgtctgacccttctcaacacagcatcagacagccacctctattgactgaagttgacaatggagaataaaactcattacccctgctgaatccaggggcccctttttacagatgagaaaagttccagaaagacccagagacataatcaggtacctgcgtcgagctctgcacaggtgactgggactgcaaccccggagaccactgtgtcagcaatgggtgtggccatgagtgtgttgcagggtaaggacagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413450 - DNA, 238 bp, Homo sapiens
gagaagacgacagaagggatgacgatcttaaggacagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413451 - DNA, 483 bp, Homo sapiens
ccgcctactactactaaattcgcggccgcgtcgacgcaacatgaagttggcagccttcctcctcctgtgatcctcatcatcttcagcctagaggtacaagagcttcaggctgcaggagaccggcttttgggtacctgcgtcgagctctgcacaggtgactgggactgcaaccccggagaccactgtgtcagcaatgggtgtggccatgagtgtgttgcagggtaaggacagcaggtaaaaacaccaggccctccctgctttctgaaacgttgttcagtctagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413452 - DNA, 627 bp, Homo sapiens
ccgcctactactactaaattcgcggccgcgtcgacgcaacatgaagttggcagccttcctcctcctgtgatcctcatcatcttcagcctagaggtacaagagcttcaggctgcaggagaccggcttttggatactgctaatcagtcctagcactctttctctttgaacctggacaaggtgtctgacccttctcaacacagcatcagacagccacctctattgactgaagttgacaatggagaataaaactcattacccctgctgaatccaggggcccctttttacagatgagaaaagttccagaaagacccagagacataatcaggtacctgcgtcgagctctgcacaggtgactgggactgcaaccccggagaccactgtgtcagcaatgggtgtggccatgagtgtgttgcagggtaaggacagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413453 - DNA, 500 bp, Homo sapiens
tactgttttgagattatgtgaatgcattgcttttaactagaatatataagatgttaatgatattattcttcaagtaataaatcatattgcatattgaatgaaaagaaaaatgtagaactgacttcttaatcaagggctgttctccctagcatctgtcccaaaagtacggtggttttcagcacatccgttcttccataggtacctgcgtcgagctctgcacaggtgactgggactgcaaccccggagaccactgtgtcagcaatgggtgtggccatgagtgtgttgcagggtaaggacagatgaagagttatcttaaggatcatctttccctaagatcgtcatcccttcctggagttcctatcttccaagatgtgactgtctggagttccttgactaggaagatggatgaaaacagcaagcctgtggatggagactacaggggatatgggaggcagggaagaggggttgtttcttttaataaatcatcattgttaaaagca

SEQ ID NO: 413454 - DNA, 396 bp, Homo sapiens
caccaacatggcaaaaccctgtctctactaaaaatacaaaaattagccagctgtggttgtgcacgcctgtaatcccagctactggggaggctgaggcaggagaatcgtttgaactcgggaggtggaggttgcagtcagccgagatcacaccactgcactccagcctgggtgacagagcgagatactgtctctaaaaaaaaaagaaaaaaaattaaataacctagaatgggcagggggttgtgggggatcctcctccctaagcgcttatcttggtgcttccagctcagtctggccaattccacctctatgagataaggagggttcagagaacccagtcactttgctgtttttctgcccacaagtttctctaataaatcttattctatgtctacacag

SEQ ID NO: 413455 - DNA, 1531 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413456 - DNA, 462 bp, Homo sapiens
accccacccaatgtatagatatgagctggggaggcggaactgcattaaacatggtgtatttgcttagggagttttgaagcaggtaagagggatctagttactttgctcctggttgcagataagcatcccctacattccgggaactattgcatgccatagtggctatactcatggactactatgattgaagtggctgctggcttcagtgaacactcactatagctgactcttccttcccacagttatgcaatgccaaccaaaaccatagaagtgttgcagttgcaggaccaaggcagcaaaatgctcctggactcagtgcttaccacccatgagcgagtggttcaggtaggcactccaggagaataaaaaatgtatttgcttctcctggttcttttctctgtccactttttcactttctattatgctcttttcttttctttcttgaataatagtgttctccag

SEQ ID NO: 413457 - DNA, 979 bp, Homo sapiens
ttacggctaggtacgaggccgggtgttgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413458 - DNA, 1589 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtagatgggactgtctagttgcaggaaaacaagctcagggcttccactgattctacattatggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413459 - DNA, 934 bp, Homo sapiens
ggtcaaggccgttccttcagtgttttcagacgccctgggaacgcggctgcagggtccggtcttcggtttgcacagctagaggccgcgcagcagcaaaggatgagcggaaccttggaaaggtgctgtgcctgaggaacaataccatttttaagcaagccttttctctcttaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413460 - DNA, 1564 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtaaaaaaataacaaaaaaagggcctcgtggcctta

SEQ ID NO: 413461 - DNA, 1664 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtaaaagggttaagaacaaacaaaaaccggggggaacatagacggggcggaaaaaaagacataaatgggacgagccaattgtccgcgccacctgtgtaagggcaacagggaccccaagaaggaaacaagacgacga

SEQ ID NO: 413462 - DNA, 1275 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggctggtctggaactcctggaaaagagcccatggaaatctgtcattaaggccagcatctgacatgggtatataaggcctctcgacgtctgatgccactgttctcttcccgactccttagttgctttagtcagctaacctcgtcattatttgccaaatgtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagcaatggcaaacaaaaccattagaagtgtgccgttgcggaccagcagcaaaagctcctggatcaggttacaccatgagcgaggggtcagatg

SEQ ID NO: 413463 - DNA, 1112 bp, Homo sapiens
ttacggctaggtacgaggccgggtgttgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgtaaaagggttaagaacaaacaaaaaccggggggaacatagacggggcggaaaaaaagacataaatgggacgagccaattgtccgcgccacctgtgtaagggcaacagggaccccaagaaggaaacaagacgacga

SEQ ID NO: 413464 - DNA, 1656 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtagagagagacggtcttgcttgtggcccaggcttgagtacagtggcatgatcatagctccctgcagcctcgaactcctgggttcaagcaatcctcctgcctcagcctctggagtagctgggattacaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413465 - DNA, 1440 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413466 - DNA, 802 bp, Homo sapiens
ggtcaaggccgttccttcagtgttttcagacgccctgggaacgcggctgcagggtccggtcttcggtttgcacagctagaggccgcgcagcagcaaaggatgagcggaaccttggaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagttatgcaatgccaaccaaaaccatagaagtgttgcagttgcaggaccaaggcagcaaaatgctcctggactcagtgcttaccacccatgagcgagtggttcagatcagcggtttgagtgctacgtttgcagaaattttcttggaaataatccaaagcagtcttcctgaaggagtcagactgtcagtgaaggagcacactgaagaagacttcaagggacgattcaaagctcgaccagaactggaagaactgttggccaagttgaagtagctactgtagaccctttcatgccagcagtggtcatattgagtgccaaagagaagagcttactgggtagttagagttcatcaggagacccaacccttagatttcataagtacccattcccatagccagtaatgtcctcactcctctgtggcttggctgtacttgccatttcttaccacttacctatgaggtaatgcttgttatcttccatctaataaaaatctgctgcagatgtgta

SEQ ID NO: 413467 - DNA, 1189 bp, Homo sapiens
aggccgaggcgggcggatcacctgaggtcgggagttcaagaccagcctgacaaacatggagaaacctcatctctagtaaaaatataaaaattaggcgggcgtggtggcgggcacctgtaatcccagctacttggagacagaattgcttgaacccgagaggcggaggtggcagtgagctgagatcgtgccactacactccagcctgcgcaacagagcgagactccgtctcaaacaaacaaaaaagtcagatctgtgctagacgctgaaaggaattaatcagacaggatctcagtcttttaaagaactttcaaatacagagaagaggtggtaacaaatcattagtgtataatattgcaagcgaaaaaccagaattgtgtgctaagtactggggtaacacagagatggtaattaattctttctggagaaacagcagtgaatgtgacaacctgagtgagggtggaaagcaggagaatttctagactctgaatttcagaagcttccggaactaaaatgatgtggaagttgagtgagtctcggtgggatattgctgctgcacctggtcaaggccgttccgtcagtgttttcagacgccctgggaacgcggctgcagggtccggtcttcggtttgcacagctagaggccgcgcagcagcaaaggatgagcggaaccttggaaaaggtgctgtgcctgaggaacaataccatttttaagcaagccttttctctcttaaggtttagaacttcaggagagaagcccatctattctgtaggtggaattctactaagtatcagtcggccctacaagacaaagcccacccacggcattggaaagtacaagcacttaattaaagcagaagagcccaagaagaagaagggaaaagtggaagtgagagccattaatttggggacagattatgaatatggggttttaaatattcatctgactgcatatgatatgaccctggcagagagttatgcccagtatgttcacaacctctgcaactctctctccattaaagtcgaggaaaggtatgaaggatgcttttgtatgggatgttcttggtgtgggtagaatgctctgtttttttgttaaactaggcttttgagatacagtttacatgtagtaaaattaactctttttagttatataatgtactacaataaaaatatagactagttctattaacctg

SEQ ID NO: 413468 - DNA, 829 bp, Homo sapiens
cgctgagcggcagggggagctgccgggagttggagcctgcggagttcgagaccatgctgctgttctgccccggctgcgggaacgggctgatcgtggaggagggacaacgctgccaccgcttcgcctgcaacacgtgcccctacgtgcacaacatcacccgcaaggtaacaaatcggaagtacccaaaactgaaagaagtggatgatgtgcttggtggagcagctgcctgggagaatgttgactctactgcagagtcgtgtcccaaatgcgaacatcctcgtgcttacttcatgcagcttcagacccgctctgcagatgagccgatgaccaccttctacaagtgctgcaatgctcagtgtggacaccgctggagggattagggccaggatggcccagctgccctagtgtgtgcttgccttgtccctcggggtagatgcttagctggcagtatgagttgtgtgtcctgagggtctttgctagtgtggtggaaagataaaccttttgaggtgaagagccagggggtcaggaaatatggcctatctgccaggcagggtggatgaagtcatgaatgtctgggagtttttctgtgtggggaggagacagagacccataactaaatatgctctgtgtaaagtcctattctttcatcttccactttattggcagttgacattcccttactcccaatcaacactcttaaatatttgtactgtttgtaaaacttagtacatgtccctaaatatttaactgttacttgtaaacttgtgtaatttattatttattttaatcaaaattctgaatatttcatttaaatgaaagttgcatattg

SEQ ID NO: 413469 - DNA, 2256 bp, Homo sapiens
actgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413470 - DNA, 842 bp, Homo sapiens
  misc_feature (815)..(815): n is a, c, g, or t
  misc_feature (838)..(838): n is a, c, g, or t
  misc_feature (840)..(840): n is a, c, g, or t
actgcgccatttcctgtccaaagctgggcgaatcagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagcggaccccagactctgaccttcagctgcagtccttgtttntggggatgactctgatgtatatncnac

SEQ ID NO: 413471 - DNA, 722 bp, Homo sapiens
tgcagacgcatctcattgcacgtgcttttgggaggtgtccacctgtggctgagcaaaggagccctggcatagagcaagggtaaccccgggagctgagtgagagaggctccttcccttacatccacatgcctttaattcctcctctgtagattgagggggttggccttgataatatctaaggtcctttcaagttctgtctggttgttcaaatggaaggaatagttaaaatctttcttctatagaaagaaagcacattagctaggatgacttcaaagtggcaacctatgggggagttctcgagagcaaggtcctgtctgatcagcctgacacacctgccacctgcagcgagtgttttcagtgctttgtgggcctccctgagggtcttacttacccctgtgatctttagggtaccccaatgccacagccacttcctgtttccacccagagtgataggactgacgttctcagccagcttccatctgagagggtgttggctctgggctccagaagcctgaaccgtggcacttatgccctgggttgtttgttttgattgtgacagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413472 - DNA, 570 bp, Homo sapiens
gtctgacttctctttagtgtacaatggagggcacacaaatatccccttcagcagtttcttggagattataaattcctctctggagcttggaaatagctttgaaataaatatttaagaacagatggatatgctggtacttcccataggttaagcagctctgggaggctctctgaagattacagaatgatgagctgtgcagatagccctcggggccaccccagctctgctctccttctctaaacagtccctccgcctgagaggcactgaggcctctgacgctgagaggctgctgaccattgtatgtttcaaaatgtaaagttcatttgttcctgccaaaccattcacgtgggtaccgtggcattccatattaggtttctcattagcaggtggctgtgttgcagcgagacaccagccagccagtttgggagtctgaagtggttttctttgtatctgtttcaggcacagaacaaactttattcagaatgcacaatggatttagtatcatcagtgacaacgaggtcataagaaggtagggatgttcatagagacagcccagcagcaaagcaaggg

SEQ ID NO: 413473 - DNA, 2596 bp, Homo sapiens
agcgggggcagcgcgcgtctggggcaggctccgcgcggggctcgggggcaggctccgcgcgcgtctgggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcaggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413474 - DNA, 2359 bp, Homo sapiens
actgcgccatttcctgtccaaagctgggcgaatcaggtccctaaatcgccggggttgatgttggctttggaagaactatttgcagagcgttttctgcactggaaggagggctggaagctttctggaagcattgccgcacggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413475 - DNA, 3309 bp, Homo sapiens
agcgggggcagcgcgcgtctggggcaggctccgcgcggggctcgggggcaggctccgcgcgcgtctgggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatccaaaaccaaacaaaaaaaaaacacaaccacatgagtggtgcagacttaaaaaacatccccaatgagggaccaaaaagaacaagcgatcccggaaacacaggaccacaaagggcgaccacattagctgcagtcagttaatataaacgacagaggcagcttgtacccgaatcatggtctacgaaaagcagacgtgcaaatcagtatacaacccagctaggcacaacaacgtggcgcgcactatagagccatgcctgccgttcaacttcgtcagcggaggaacgcctacctctgatgctacgatgatcgtctgcccgcaaacacaggtatattatatacatggcctaagtaccaaggaacgaaacacagcctgagagagccgatagaaaggggtctgacccacactgggtatttgagcgtagttcgtgcgggagtgtgctctgtatcagccttaataaggtgtttccgtatttcaaccacagcacatactaatttgactaacatatgaaacagagactacatttataaacccataatgaataaacataacaccacaaatataacaaacacatatccactgcctaaccactcaccatacttaccatcagcataacatatcactctacatctacctttcatcaatctataattatccactcgtcactaaacatcaatactgcaact

SEQ ID NO: 413476 - DNA, 1491 bp, Homo sapiens
gcatccgtggcctgggactcatggttccgtgattgatcctggtgacccatggctctggattataaaactatactttctcaaacctgtatttggtgaatctaggggtgaaataaaaccaaatggaaaagaaaatcaagactgattttcagacttttaagatagctctcctttgtccattctaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413477 - DNA, 1959 bp, Homo sapiens
cgtggtagaggtccctgtattcaactctcctcagttgcccagtgcaagtgtgccatctgtttcctggcaggaccatgactgatccaggtaggggatagttctcgctgacattctactgttcgaatgttctttctgtgtgaactgaaaactgcctgatgcagaattgtgtgttaatatcagctgttggtttcattacaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413478 - DNA, 1332 bp, Homo sapiens
agcgggggcagcgcgcgtctggggcaggctccgcgcggggctcgggggcaggctccgcgcgcgtctgggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgtaagccagagatgtgtgtgatctcatgagtgctgtcagtgtgaagggacacattcagaggtctgcctttaccaggccaag

SEQ ID NO: 413479 - DNA, 298 bp, Homo sapiens
tcttagaaataaaccccaagctgcaaacccaggtgaaaggtgagcacgttcctgctgaggtccttcatctgaactccacctccctctgccccctgccttagaatgccttccgtgctttcactgcccttggccactaggcagcggcggatcctctttcctgcacagttgggtcctctgtgttaaccagcccactctgctcctctgtttgctgtgctcccttgcaaatagtaatattttccttcttcattttctacaccatcctcccttagacacttttagactcccttgaatccccaac

SEQ ID NO: 413480 - DNA, 384 bp, Homo sapiens
ttcccctctccaccccctgagcttgtgtgatatatttaagctgtacctttaaggtaatgtattctaactcatttccaactcataagccacagctgaggtcccttgacctgggcagccttgttttgcagactcggtcccatagcaattgtgcccatactcagatctcctgatttaaagcaagccccatgaattctgagcccttcagttttgatggttaaaagaaatgacctcttgtttgtaattgatttgccttcttggtttatatacatataaattagagtggtttttgaaatttgtttctttgtttttatggtaacctacgtctacagagtgcagaagaaataaactcaggtaaggacagcatctctcttcccaattttcatt

SEQ ID NO: 413481 - DNA, 2630 bp, Homo sapiens
agcgggggcagcgcgcgtctggggcaggctccgcgcggggctcgggggcaggctccgcgcgcgtctgggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413482 - DNA, 2548 bp, Homo sapiens
actgcgccatttcctgtccaaagctgggcgaatcaggtccctaaatcgccggggttgatgttggctttggaagaactatttgcagagcgttttctgcactggaaggagggctggaagctttctggaagcattgccgcacgtaaatgagtgcctcttggcctaaaacagcagttggaatgaaagggatcaccctgctgttattcattgacataaacaaaactgtcataaaaataatcacttggctcttagttttagaaggctaataagcctgaccgttctgtttagtgctttattattattaatttcaccattatgctgcatcccttagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413483 - DNA, 2566 bp, Homo sapiens
actgcgccatttcctgtccaaagctgggcgaatcaggtccctaaatcgccggggttgatgttggctttggaagaactatttgcagagcgttttctgcactggaaggagggctggaagctttctggaagcattgccgcacgtaaatgagtgcctcttggcctaaaacagcagttggaatgaaagggatcaccctgctgttattcattgacataaacaaaactgtcataaaaataatcacttggctcttagttttagaaggctaataagcctgaccgttctgtttagtgctttattattattaatttcaccattatgctgcatcccttagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtcattctcttttatgcagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413484 - DNA, 2598 bp, Homo sapiens
agcgggggcagcgcgcgtctggggcaggctccgcgcggggctcgggggcaggctccgcgcgcgtctgggggcaggctccgcgcggggctcgggcacaggtccccgctgccgcagccctaccgagtgaagcactgagcgcggcgccgcttcgccatcacctggctctggccctctcaccctagcgtaggggggcactggccaggcagtgaggaccctgagatccatgccctgggagacagaggttgtctcctgtccatgcacccgcgcgcctgccttctaaccttcataccgttgggcagattaattcactggactaggcctctgttccgtgggagttgaaaagatttgacctggaagaaaccctagcgattattcagttaagccgcaaccccaccccctgttttatatagggattccggttcacaatggatgctgataaagagaaagatttgcagaaatttcttaaaaatgtggatgaaatctccaatttaattcaggagatgaattctgatgacccagttgtgcaacagaaagctgtcctggagacagaaaagagactactgcttatggaggaagaccaggaggaggatgaatgcaggaccaccttgaacaagactatgatcagtcctccacaaactgctatgaagagtgcagaagaaataaactcagaggccttcttggcatctgtggagaaggatgcaaaggaacgagccaagagaagaagggaaaacaaagtcttggcggatgccctaaaagaaaaagggaatgaagcatttgctgaaggcaattatgaaacagctatcctgcgctacagtgagggtttggagaagctgaaggacatgaaagtgctgtacaccaaccgagcccaggcttatatgaaacttgaggactatgagaaggcactggtggattgtgagtgggctctcaagtgtgatgaaaaatgcacaaaagcatattttcacatgggaaaagccaacctggccctgaagaactacagtgtgtctagagagtgttataagaagatcttagaaataaaccccaagctgcaaacccaggtgaaaggttacctgaatcaagtagatcttcaggaaaaagcagaccttcaagaaaaggaagcccacgaactgctggattcaggaaagaacacagccgtgaccaccaagaacctcctggagaccctttccaagcctgaccagatccccttgttctatgctggggggattgagatcctgactgaaatgataaatgagtgcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggcccatcccctcccccctcttcttatataattttaaggcctgttaatgtagcatccatcaaccaccacacctcagttttgcttcatagaagcagggagtgagtgcctttggggtgcccgcctatgctcaccgcctgctgttccaattttgatttcccccttttgtgtaaccaattcaaaaacaaaaa

SEQ ID NO: 413485 - DNA, 1838 bp, Homo sapiens
gtctgacttctctttagtgtacaatggagggcacacaaatatccccttcagcagtttcttggagattataaattcctctctggagcttggaaatagctttgaaataaatatttaagaacagatggatatgctggtacttcccataggttaagcagctctgggaggctctctgaagattacagaatgatgagctgtgcagatagccctcggggccaccccagctctgctctccttctctaaacagtccctccgcctgagaggcactgaggcctctgacgctgagaggctgctgaccattgtatgtttcaaaatgtaaagttcatttgttcctgccaaaccattcacgtgggtaccgtggcattccatattaggtttctcattagcaggtggctgtgttgcagcgagacaccagccagccagtttgggagtctgaagtggttttctttgtatctgtttcaggcacagaacaaactttattcagaatgcacaatggatttagtatcatcagtgacaacgaggtcataagaaggtgtttttccacagcaggaaatgatgcagttgaagaaatggtctgtgtgtctgttctcaagctctggcaagcagtgtgcagcaggaacgaggaaaaccagcgtgtgctagtgatacaccatgacagggccaggctgttggccgccctcttgtcctccaaggtcctggccatccggcagcagagctttgccctgctgctgcatctcgcccagactgagagcggacggagcctgatcatcaaccaccttgacctgaccagattattggaagcgctggtgtcatttcttgatttctcggataaggaggccaacactgctatgggactgttcacagacttggctctggaagaaagattccaagtctggttccaggccaaccttccaggtgttctccctgcactcacaggcgttctgaagacagatcccaaggtaagcagctcctcggctctgtgccagtgcattgccatcatgggaaacctcagtgctgagcccactacccgaagacacatggcggcctgtgaggaatttggggatggctgcttgagcctcctggccaggtgtgaggaggatgtggacctgttcagagaggttatctacacactcctgggactcatgatgaacctgtgtcttcaggctccctttgtctctgaggtttgggctgtggaggtgagcagaaggtgcctgtctttactaaacagccaggatggaggaatcctgacaagagctgctggtgttctgagccggaccctttcttcctctctgaaaattgttgaggaggccttgcgagcaggagtggtaaagaaaatgatgaaattcctgaagacaggaggtgagactgcatcacgttatgctataaagatactagctatctgcacgaatagttatcatgaagctcgggaagaagtaataagactggataaaaagttgagcgttatgatgaagctgctcagctcggaggatgaggttctggtgggcaacgctgccctctgccttggtaactgcatggaggtgcccaacgttgcgtcttccctgctaaagacggaccttttgcaggtcttgttaaagcttgcaggcagtgacacacagaagacggccgtgcaggtgaacgcaggcattgctctggggaagctgtgcacagctgagcccagatttgctgctcaactgagaaagcttcatggcctagaaattctcaactctacgatgaaatacatcagtgattcttgagagagacagggtttgtgtgcatttggggaacacacagatgcacaccgtgtgttgttcctatgctaataaagacctttgatgtatcca

SEQ ID NO: 413486 - DNA, 866 bp, Homo sapiens
ggcaaacactgtttcctgcccctgccctgtaattctcacagatattcagaaaggtttggttgccctgtgcctcagtaaataaggaaaatgctttcttagaaggctgctccagtaactgcatattccttgccatcctctacagaaatcaccatctgctctcctaagttcttctggaaagagcaccgtaaccatgtcatcctaacagcaatgccatgaagaaagggaggcagctccctccacgtcctggctccagtgcccactcccgtgccccctccatggcccacgcagcctggccacctgggtgacatctggtccctgtgtcactttctgcaagacaaggaccagcctcaaagaggagagcatggtgtcctgaaggagatggcggccaccatcacctgtcctgtggctttcctctgactgcccaggtgggggcccagaggcggcgcctctcagtccagctttgagtggagttacataatttccaggcttccctgcagttctcgcctccccatccctgaactgtttacacagtagctctcacccacaaagagtccgcatgatggcttttcctctgtttggaagatgtggatggctgtgtcccaagtttttcctacctaagatccttttcagtaggggatggatttggtctatctgatgatcaagagttcagggtggcctttgtgatagtgttacaccccctcccaggtccaataaacagtcttctgacaaataatggcccttccttttccttccccacctgtccaccacctggtaatgtgatgtaagcgtggcaaaatcccacacaccccttccagaaatcccaggactcgtgtgggaaatactgtcataattaaagccttctgaga

SEQ ID NO: 413487 - DNA, 1326 bp, Homo sapiens
ggagcccaggaggggccccaagaaaagaaaggcagatctgctctgtgattagaatggaagacatcactactaagaggaaactaacactgtagtcttgtgcagaaaaagggcagagactacagccactgcatcagggactggtggcagcccaacgtggctgaggggtggccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatgaaaaaaca

SEQ ID NO: 413488 - DNA, 823 bp, Homo sapiens
  misc_feature (753)..(753): n is a, c, g, or t
  misc_feature (756)..(756): n is a, c, g, or t
gcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcaggcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatgggctaanccncaggcctatatgaagctgcttactaccatggacagcctgttgtcaggcccgtctcatgcacacgagg

SEQ ID NO: 413489 - DNA, 516 bp, Homo sapiens
tttgttttctatctagagacgaggggcatcagaagattgagcctagtgtttctctccaggttatggggagttcctgactgtccacacttctttcagcagctgcctgaaaccacaggtggttccgacaaataatccactaaaagaggcctgctgtcccaagaatccacattctggttagaccttccccacaaagctggtgtctgcagacccctcacaggcacctgttggccagtcttgcctaccccagctcacagagacctgtgatggaattctggtcagctctttgtttccaggtgaggcagatgccatggggcagttgggctgggagttgtgacttggtataactaactcattcagctgtataatgtcacaaaaaagggtcaaggctggtggggagagggagcagcaacccacaaaaagtccctcagaactatggtgtctgatgcaaagatagatctgtgtctttctcttcctcccctccttgcctttcccaagtctttctcctgtagcccatct

SEQ ID NO: 413490 - DNA, 1251 bp, Homo sapiens
gcagggactggtggaatcccgatgtggctgaggggccgccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcaggcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatgaaaaaaca

SEQ ID NO: 413491 - DNA, 1302 bp, Homo sapiens
ggagcccaggaggggccccaagaaaagaaaggcagatctgctctgtgattagaatggaagacatcactactaagaggaaactaacactgtagtcttgtgcagaaaaagggcagagactacagccactgcatcagggactggtggcagcccaacgtggctgaggggtggccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcaggtgcctataaatccctctctttatctggtgaaatatgatggaattgactgtgtctatggactggaacttcacagagatgaaagggttttgtctcttaaaattctttctgacagggtggcatcatctcacattagtgatgccaaccttgcaaataccataattggcaaagcagtggaacatatgtttgagggagagcatggttctaaggatgaatggagggggatggtcttagctcaagcacctatcatgaaagcctggttttatattacctatgagaaagatcctgtcttgtacatgtaccagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatgaaaaaaca

SEQ ID NO: 413492 - DNA, 677 bp, Homo sapiens
cccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcagcttctagatgattataaggaaggtgacctccgcatcatgccagaatccagtgagtctcctccaacagagagggagccaggaggagttgtagatggcctaataggtaagcatgtggaatataccaaagaagatggctccaaaaggatcggcatggtcattcaccaagtggaagccaaaccctctgtgtatttcatcaagtttgatgatgatttccatatctatgtctacgatttggtgaaaaagtcctaactgttagggtaaaatttggcacatgtgtggaaacaaatgtataatttgtagacatgcaaaaaatgttgcctttcagtgtattgaaagcttatggaatccctgataactaaacatctttgccagcattaactgttgttttgctctaaaaaatacaaacttgtgtgtacatgaaaaaaca

SEQ ID NO: 413493 - DNA, 852 bp, Homo sapiens
ggagcccaggaggggccccaagaaaagaaaggcagatctgctctgtgattagaatggaagacatcactactaagaggaaactaacactgtagtcttgtgcagaaaaagggcagagactacagccactgcatcagggactggtggcagcccaacgtggctgaggggtggccaccgccagcagggaggcggagggctagcgagccaagcggtggggacgccgctgccttcctctttgcctgtctcgccgccctcctagacacgctcctcatctacggatcctaccctccccgctcttgcaagcattcactcggccggtcgcctgctgaccctccttcgccacaggctcgtagcggaggcagcagcgaggtgtccgatttgggcacgtgaggcccgcgatccccggcggtggacgccaggcagggcaaggccattagtgggcgccagaatggagagggggatgggaaggaatccagcaggagacatggggtggagttgggcgccaggcaagggtggggtgggggagtgcggtgagcaacatgaaaagggggtaggaacgggagccagacaaggatttgaaggtgagcgccgggaagcaagggcggtgggtaccagagaagtggttagggtaggcagggggtgttgtggacagcagctgggacgctcagggaaggagggcagtgggtgccggtcaaggcctctttgcaaggggattggaagtggacgccagtggtagcaaggggttccgggagggcagtgggctctgagctaggaggaggtggcccagccacttctgcagagttcctaaccccagacagctctactgaaccaccccagcccttccccacagcccaa

SEQ ID NO: 413494 - DNA, 667 bp, Homo sapiens
cccggcggtggacgccaggcagggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaaggaaggagatgagcccatcacgcagtggaaaggaaccgttctggatcagctgcctgaaaccacaggtggttccgacaaataatccactaaaagaggcctgctgtcccaagaatccacattctggttagaccttccccacaaagctggtgtctgcagacccctcacaggcacctgttggccagtcttgcctaccccagctcacagagacctgtgatggaattctggtcagctctttgtttccaggtgaggcagatgccatggggcagttgggctgggagttgtgacttggtataactaactcattcagctgtataatgtcacaaaaaagggtcaaggctggtggggagagggagcagcaacccacaaaaagtccctcagaactatggtgtctgatgcaaagatagatctgtgtctttctcttcctcccctccttgcctttcccaagtctttctcctgtagcccatct

SEQ ID NO: 413495 - DNA, 345 bp, Homo sapiens
agggagagcactgcgggcatgcagccaggatttccagcattgcttccaggctcctaggggaaacttaggcactagcgcagactacatccagacatggctatagggaaaagtttgccttgtggcacactgggtgtgtctctctatcctctctcctcccccagcaggcatgaagacccccaacgcacaggaagccgaagggcaacaaaccagggcagctgcaggacgggccactgggtctgcaaacatgacaaagaaaaaagtctcccaaaagaagcagagaggccgaccttcatcccagccccgcaggaacatcgtgggctgcagaatttctcatggatggaagga

SEQ ID NO: 413496 - DNA, 385 bp, Homo sapiens
agctcagctccttctcccaagctgcttataagtcattcctccgctctcgggaaagagagttagggaggctgggaaaaggatggaagctgcctttccgatattcttccctcttgggaatggagcgttcctctcctcattgcaacacaaggtaggagaggcagccactgcccccatgctggctgttgctcatcccagcccaatccaagatgcttcagaggaaagactgccagcaaccagccaggcaggatggtgctgtggtggcaattttagtccagtagacctggttctagttccagctcctccactgactgctacatggcctttggcaaattcttagcctgagtttccccatcttctataaaacagagttgttcaattgagagag

SEQ ID NO: 413497 - DNA, 778 bp, Homo sapiens
tctcctagtagacaaagtccttacctgtctgccagtccccaaccccatgcatgcaattacctcatggaaggacggaaggggggcagggaagaggggacctcctagcccaccaccttccaacacacctctgcagagcccaggccctttcaggcaccccagtcacagccacaccaagcttctagctactgctcagcacacacttaccacctggtttccctgtgcttctcatttgtaattttggattttagtctagttcagacattccttcaattcacattaagcatccatttcctctctgatattcttgtctctggtcccttttttgtcttatccatttggacatctattcctaagcaaaacattctaaattctattttcattatcttactccttagcccagatcaccagaagctccctactatcaacacaaattggaaaatctctggtgtgattatgaggagaccattcagtattttctttgacactattaaacaacattgagtttgcctaatgtcagtactaaaggccaggttgtaaaatagtaaaacctgcagtggtctctaaggcaactagctgtttattatagtagttggggaaaggaagatataaaaaatcttctaaggaactttattatagatctgtttacttaagtaaagcatatacaggaagatgcgggaatcataataaatgcttatgaagcaaaactaaatgcacctgtactactacatccagattcacatacaaacgacaaagagctatatccagacctggcatgtgt

SEQ ID NO: 413498 - DNA, 1686 bp, Homo sapiens
ggaatggctgaaaaagcccacacctggaaatcactccctccctgctcctccacggcaggttgcatctgcgagacgcttcggtcattagaggaatgagccgggagtgagcaattcaccagctctccagcacttggtggaaagcagcaggcaaggatggatgtggttgacagccttcttgtgaatggaagcaacatcactcctccctgtgaactcgggctcgaaaatgagacgcttttctgcttggatcagccccgtccttccaaagagtggcagccagcggtgcagattctcttgtactccttgatattcctgctcagcgtgctgggaaacacgctggtcatcaccgtgctgattcggaacaagcggatgcggacggtcaccaacatcttcctcctctccctggctgtcagcgacctcatgctctgtctcttctgcatgccgttcaacctcatccccaatctgctcaaggatttcatcttcgggagcgccgtttgcaagaccaccacctacttcatgggcacctctgtgagtgtatctacctttaatctggtagccatatctctagagagatatggtgcgatttgcaaacccttacagtcccgggtctggcagacaaaatcccatgctttgaaggtgattgctgctacctggtgcctttcctttaccatcatgactccgtaccccatttatagcaacttggtgccttttaccaaaaataacaaccagaccgcgaatatgtgccgctttctactgccaaatgatgttatgcagcagtcctggcacacattcctgttactcatcctctttcttattcctggaattgtgatgatggtggcatatggattaatctctttggaactctaccagggaataaaatttgaggctagccagaagaagtctgctaaagaaaggaaacctagcaccaccagcagcggcaaatatgaggacagcgatgggtgttacctgcaaaagaccaggcccccgaggaagctggagctccggcagctgtccaccggcagcagcagcagggccaaccgcatccggagtaacagctccgcagccaacctgatggccaagaaaagggtgatccgcatgctcatcgtcatcgtggtcctcttcttcctgtgctggatgcccatcttcagcgccaacgcctggcgggcctacgacaccgcctccgcagagcgccgcctctcaggaacccccatttccttcatcctcctcctgtcctacacctcctcctgcgtcaaccccatcatctactgcttcatgaacaaacgcttccgcctcggcttcatggccaccttcccctgctgccccaatcctggtcccccaggggcgaggggagaggtgggggaggaggaggaaggcgggaccacaggagcctctctgtccaggttctcgtacagccatatgagtgcctcggtgccaccccagtgagatgtcccctgaccctccaccgcagaaggaaggcagggaggaggcagagaagaaagaacggaagaagagatcaggaagagaaggagcagagcagagctgatggagaaggaaggctccatctccagtgggaactcttcaaggtctcttttcatccttcatctgattccagagcactgctccagtggggccatgattggtttctaggcagttcaaagcaggatatgttaagtaacactcaaccatcag

SEQ ID NO: 413499 - DNA, 546 bp, Homo sapiens
agttatgaccacacaataaagcaagccacacaaatctttggtttctcagtgcatataaaaaattacgtttacactgtatggtagcctattaagtgtgcaacagcattatgtctaaaaaaagtacagattattaattaaaacatactttattgctaaaaaatgttaacaatcatctgagtctcaagtgagtcataaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccaca

SEQ ID NO: 413500 - DNA, 519 bp, Homo sapiens
caagatgaaatcatagaagaaagcaggaggtacatacacacaatgcaagtttatcaggtcagagaattttgtattttaagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccaca

SEQ ID NO: 413501 - DNA, 1011 bp, Homo sapiens
tacattttagggccagagaagaggggaactggaatcagtgtttaaggtgtacatttcagttagggaagataaaagttctggatggtgacagtcccaaaacaatgtgaatgtacttaatgccacagaactgcacgcttaaaaatggttaaaatgggtaagtttataatatgtatactttaccacaatataaataaggaaaatcccattagactgaaaatcttaagtcacatacacttaaaatacaaaattctctgacctgataaacttgcattgtgtgtatgtacctcctgctttcttctatgatttcatcttgtgctgctccttcatgttgcagacatccaggcctttttttcagttttcagtaccaccaaagtcacctttttttggaaggttaggcaaattttatagagtttattaatttgctcaatgcactgatcttatggtggtgaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccaca

SEQ ID NO: 413502 - DNA, 1725 bp, Homo sapiens
  misc_feature (1029)..(1029): n is a, c, g, or t
tttccatgggcagggtcgacagactcccttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacctttacaagaaaaaaggctgtggtgactcagtgttcctataaattcagaatgtggaaactactaatccaaagcatcacttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagngacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagcaaaaagctttctttctctatacagtgtatatctctaaactttttttcctcagttttagagaacatctgttttatctggtggttctttgtttgaatgcaaactcataactttcaagtctccggtgcaagagcataatctacagatcatgggcaaaatctagccacagtcctgagagtccaggcttctgggatgcccagctgggtataaaagtccctactaaccctgtttcaaattcagaggtttctttggtttagaatgcctcaatgagattttgatacatccaagagagaaaaaaaaaaaa

SEQ ID NO: 413503 - DNA, 1558 bp, Homo sapiens
  misc_feature (1029)..(1029): n is a, c, g, or t
tttccatgggcagggtcgacagactcccttttcagtgatttctggctctgagaaacctctttactcactagaaaagaactttatttaaatggccaattttgttcctcagaaaaagaaattaaaaaaaaagaaaaataggatactgaagacagaaccatgtgacttggtgacaaacaaaaggaggggtgcactagaatttcaataggctccctaattccatagaaaaagcaaagcaacccaatgcctcctgagcctgcagtgcatgaagagagtgcttgagctgacccagccaccaggccttctggggctagacataacttcccactggaacagcagcagcctctttcccctctttgtgttttcatgaagaaaacggctgttctcttaggtagccaggaaatagattacatggggcaaactttcaaaagcaatctctaccctggtgctcaggctacatacagaggcagaaaaggggcacggaagagcccttgctcttgagagagagtattttcatattcccaagggctttccgtgtagagttgctatttctgatatcacttaaacctttacaagaaaaaaggctgtggtgactcagtgttcctataaattcagaatgtggaaactactaatccaaagcatcacttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagngacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagcaaaaagctttctttctctatacagtgtatatctctaaactttttttcctcagttttagagaacatctgttttatctggtggttctttgtttgaatgcaatcagctaaatggaatcgtctaaagcaagacaggta

SEQ ID NO: 413504 - DNA, 416 bp, Homo sapiens
agccagaaagcccacttccgagtctcactgtagtggttaagggtagagacggcaaccagatgccggcatctggactccatctccaccgttcttggcaggctagctaacctctctgtgccttggtttccccatctctaatatggggatgtctacggcacttatctcatgtgggtactgtgaggatgcgtggagctactgcaggtaaacagggcctggctcggtcagtcctgcctgaggttcgcgatttcaccctgacagccgtggacctttggacaaaccactcaaccaccccaagtttctccggactcctgagaaagcggaatccaagtaatgcctacctccaaacgggcgctgggcaacacaggggcaagtgctttgtaaatggaacagcacttaacaaatagcagttgtggtta

SEQ ID NO: 413505 - DNA, 479 bp, Homo sapiens
gatccagctggaatttgaggacactggaacaatgaggtcagcttccaaaacaaaacaaaacaaaactttaaacatctgtgtaagtacagggtggaatataatgaattccaggtacccatcacttaggttccacaattagccatggccaatcttgtgtgataggtatgtccctacctatttctcccctgccctcattgtgaagtaaatattttcctaaaaggtctttttaaaattaagttataaccatgccatcattgtacaaaaataatgatattaatttcttaatataatcaaatattcagactattcctttttccttcagtctcataatttttaacaatttgatcaaatcagaatcccttacaatccatatgttgtattttaatgattacctcttgtctcttttaatctaattttcacctctttctctttttattccttgtgttacttgaataaactagatcgttcgtcctgtcatt

SEQ ID NO: 413506 - DNA, 455 bp, Homo sapiens
tgagaatagaattttaaaacatttactcatcagcatccaagggtggggagcagtgtcatctaggagactggttctattatttacgtagatgttcttgaattaaaggatgggaatattttttccttccaaaactttttttcaattttatattctgtttttcaagtttttattatgaaaatattcaaactcacagggaagttgaaagactaatacaaagaagaaccatactctttccactgacatgatccaacgaggaatattttgccacacggcaaatatataccgtataattttctgtaccacttgatagaaaggtaaagaatgaatattgttttttaaataacttttttcgtatataagtaatatgtgcttatcgtgtaactacctaaaaacattgaaaaataaaaggaaaataaaattcatacataaccgccctgcccagattaactatcttt

SEQ ID NO: 413507 - DNA, 1522 bp, Homo sapiens
gatttgacaaagtcagaaaagagcctgcctgtgtttataccccacctgagctgctttttgcagtagttgagtttcagctgtatatttggctgtttaagcctgaagtgaagaactgaaaagactagtattgttgaaataccttaagagtaaataataaatctgttagacacttttagcaagttagatacattttgggcaactgctgatgccttggcatggtattgatgctttattcatatgtttttattatacgttgaaattgttttttgcccccacagggaagttaagatatgccaacaacagcaattacaagaatgatgtcatgatcagaaaagaggtatgagccttctgccttctgagagtccttcatttgctacatttcagctttttgtcttgcattgtttttattgtttctagtagtattgaaagataaagaacagggagagagacacatgtctgtagacagcttctggattatttcccaaatcatcttttagttgggatttttttattttacattgtggaatcaattactggtaacctttgacataccttggtttgaaccctgagtctgctgcttactaccccatgtgaccttgggcaagttcctggctgaacttgataaatctctgtttcttcacctgtaaaaacaggaataataaaagctacctcccactcccaagtgctgtcataaaattaaatatgttctatttaaagtgctctatattccctgtgtacatggtacacaatgaagagctatttaatttacatctgagtgggaaagggagcatgggaaagcagttgacatcattgaatgcatgttagatgtcaggcgtggcatcttatttaaccctgattgtaagcccatgtgatgggggagggtattatagcccccttacaaataagaaaataaaggcccaggtattaattatgaggcttgttctgagttacccctgctagtaagagatacagcaggaattcccaatcctgccccagtaaagtttgtattctccgttctgtgatttctactacatcattaaggcttcatcaaagctactctttccttttaaccactttgccacctttgaaaatgtcttagcatatattttcatattgttattttagctattgattttatgcttattcacacatgtcaatatcctcactatttttttacacaggcatatcttttaaaatacattttgctcctcaggagtgtattacctagttaagaataactggccgggcgcggtgactcacacctgtaatcccagcactttgggaggccgaggcgggcggatcacgaggtcaggagatcgagaccatcctggctaatacggtgaagccctgtctgtactgaaaatacaaaaaaattagccaggcatggtggcgggtgcctgtagtcccagctacttaggaggctgaggcaggagaatggcatgaacccaggaggcagagttcgcaatgagccgagatcgcaccactgcactccagcctgggcgacagagcaaggctccgtttc

SEQ ID NO: 413508 - DNA, 648 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 413509 - DNA, 680 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaatttttattattttataaagacctgaacatgtg

SEQ ID NO: 413510 - DNA, 710 bp, Homo sapiens
  misc_feature (528)..(528): n is a, c, g, or t
  misc_feature (530)..(531): n is a, c, g, or t
  misc_feature (539)..(539): n is a, c, g, or t
  misc_feature (624)..(624): n is a, c, g, or t
  misc_feature (702)..(702): n is a, c, g, or t
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaggatccagaaggcttacgagtattttattatcttgtccaggacctgaagtgtttggtcttcagtcttattggattacacttcaagattaaaccaatctagactgaatattggtgtggacatggggggtggntnntttttgtnttgttttttttgtgtgttttttgttgttttggtttttttggggttttttttttgttttgtgttttttttggttttttttgtgttngtttttgggtttttttttgtttttggggttgtgggtttgttttggtttgtggtgttgtttttgttgttttgtttggtnttttgtcc

SEQ ID NO: 413511 - DNA, 651 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaggatccagaaggcttacgagtattttattatcttgtccaggacctgaagtgtttggtcttcagtcttattggattacacttcaagattaaaccaatctagactgaatattggtgtggacatggggggtggttccttctccctcattctttctttcttatcccattatatctcacttctgccttcgttattaattctctctctctcgtgccacctagtatttccctcacatatctgatctttcccctctctcccc

SEQ ID NO: 413512 - DNA, 590 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaggatccagaaggcttacgagtattttattatcttgtccaggacctgaagtgtttggtcttcagtcttattggattacacttcaagattaaaccaatctagactgaatattggtgtggacatggggggtgggctctctttcctcctctactctctctttactctgcccttcctgtcttgttgttttttgtcttg

SEQ ID NO: 413513 - DNA, 766 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggtgtgttttattgattatcctgtagtgcagaaatcttacaaataagaccccccacactccctcctccacttaaagcttttgttgcctatctcacttactaactactatggacaaagcattgtggagatacaaagagaaatagaacataattatttcaacaatctaatgaaaggaaaatcatacaaataattcagtgtatgtatttaaattcatgtatatttatatacattaatgtatatattcattctgagcaccattttggtaactaaaaaataaaagccactgtcatattgaactgaattaacagaaaaggtattttcactcttgactgctaccatcctaatccagacttctaatagatttccttgtttttcctcttgttccataccatccatttttccatcctgaaagccagtgtga

SEQ ID NO: 413514 - DNA, 651 bp, Homo sapiens
cacttaaggagatgccagaaataagtctgcaggaacagttatttttatcttccatcactatctgagtcaaagcactgcttaaggatacaacatacattttgttttttaacttgcgttcaggcttatgtacataaaagcgtgatggaggaactgaagagaataattgacgacagtgaaattaccaaagaggatgatgcattgtggcctcctcctgaccgagtgggccggcaggtgtgttttattgattatcctgtagtgcagaaatcttacaaataagaccccccacactccctcctccacttaaagcttttgttgcctatctcacttactaactactatggacaaagcattgtggagatacaaagagaaatagaacataattatttcaacaatctaatgaaaggaaaatcatacaaataattcagtgtatgtatttaaattcatgtatatttatatacattaatgtatatattcattctgagcaccattttggtaactaaaaaataaaagccactgtcatattgaactgaattaacagaaaaggtattttcactcttgactgctaccatcctaatccagacttctaatagatttccttgtttttcctcttgttccataccatccatttttccatcctgaaagccagtgtga

SEQ ID NO: 413515 - DNA, 426 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcgctggagtgcagtggcataatctcagctcactgtaacctctgcctcctgggttcaagcgattctcctgcctcagcctcccgaatagctgggattacaggcgtcctccaccatgcccagctaatttttgtatttgtagtagagatggcgtttcaccatgttggccaggctagtctcaaactcctgacctcaggtgatccgcctgccttaccctcccaaagtgctgtggttacaggcgtaagccgccgcatcctactggtctgatctttaaaaacgt

SEQ ID NO: 413516 - DNA, 537 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 413517 - DNA, 1582 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaagtaagtgtgcatgatccttatatccagttgtgtctgttttggagcagattgataagaaaccttaaccaaattgggaccattatgggaagagctggggcaaatgcaaaatgcaggtgggcagctttgtccttcttgttagggaggaaccccaaattatttttgaggacttgctcctattacttttggtgtttcattcagccattgctactgcgagcttcttgttgacacacacatatagattaatgcataggagcagccagaagaaaaaatggaatatgccaaaaaagtgctcatgataaactgtagagtcaccgagtctgaatagctttctcagtgtgactgttgagactggcacatcttaaaatctgacttcagtgaaacttgacattttttaggatctaagttttattttattataaatttattattattattattttgaggcggaggttacagtgagccaagatcatgccattgcactccagcctgggcaacaagagcaaaactctgtctcaaaaaacaaaacaaaacaaaacaaaaaaagttttctaactctgaaagtaatacatgctcattgtagaaaatacaggaaatgtagaaaagtagaaaggggaaaatcatccacaagtttatcaatcagacaaccattattactatcttgcagtatttctttttagtctttaatgcatttattctatgcattaatacaatatatactttttaagaagcataaaaaatacagttgagattaataattgttattttaattatattttttcacttaatgtaagcatttccctatattaaaaactcagcatatttaaattacctcataatataccgttttaatatatagtcttttcctttttagggacacttgatgggtcaaagttttaatgcctaaacttttttccttttgtattttagggatccaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 413518 - DNA, 1243 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaagtaagtgtgcatgatccttatatccagttgtgtctgttttggagcagattgataagaaaccttaaccaaattgggaccattatgggaagagctggggcaaatgcaaaatgcaggtgggcagctttgtccttcttgttagggaggaaccccaaattatttttgaggacttgctcctattacttttggtgtttcattcagccattgctactgcgagcttcttgttgacacacacatatagattaatgcataggagcagccagaagaaaaaatggaatatgccaaaaaagtgctcatgataaactgtagagtcaccgagtctgaatagctttctcagtgtgactgttgagactggcacatcttaaaatctgacttcagtgaaacttgacattttttaggatctaagttttattttattataaatttattattattattattttgaggcggaggttacagtgagccaagatcatgccattgcactccagcctgggcaacaagagcaaaactctgtctcaaaaaacaaaacaaaacaaaacctacatagatttttccaaatctgagaaatggtagggccttaagggtacaacttcttctaaatatgagctgtatttatctcttgtttctagtgcccagcacagtttagtgctcagagtgaactgcccttgtttttgtggccatctgtagtcaagtttgtgtgatttggcaaatgattaatccttctgtgtgcttgatgaataatccaattctacttgacttcgattttctaaaatgtttctaggagcttgaaatccgtcattggagatgaacacatttc

SEQ ID NO: 413519 - DNA, 847 bp, Homo sapiens
taattaaaatcttgatcccttttcaccaaaccaatgcttttgtaaaaaacaatatatttaaggctgggcgcgtggtgcatgcctgtaatcctagctactcgggaggctgaggcaggagaatctcttgaacctgggaggcggaggttacagtgagccaagatcatgccattgcactccagcctgggcaacaagagcaaaactctgtctcaaaaaacaaaacaaaacaaaacaaaaaaagttttctaactctgaaagtaatacatgctcattgtagaaaatacaggaaatgtagaaaagtagaaaggggaaaatcatccacaagtttatcaatcagacaaccattattactatcttgcagtatttctttttagtctttaatgcatttattctatgcattaatacaatatatactttttaagaagcataaaaaatacagttgagattaataattgttattttaattatattttttcacttaatgtaagcatttccctatattaaaaactcagcatatttaaattacctcataatataccgttttaatatatagtcttttcctttttagggacacttgatgggtcaaagttttaatgcctaaacttttttccttttgtattttagggatccaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaa

SEQ ID NO: 413520 - DNA, 641 bp, Homo sapiens
ggcgccgccgcaaacgtcagtgtcgggcgcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaggatccagaaggcttacgagtattttattatcttgtccaggacctgaagtgtttggtcttcagtcttattggattacacttagactgaatattggtgtggacatggggggtgggtgggagtagaaaattttgtgtatatcagggcagtatttttttatgaactataaatatgtgataaaatccaatttttattattttaaaagaaaaaaagcaaacttaaataaaagaactcaatagtataaaa

SEQ ID NO: 413521 - DNA, 111 bp, Homo sapiens
gatcgcgccattccactccagcctacacgacagagtgagactccatctcgaaacaaaaaaaagacttgatttttattttcactatctttagcataaattgttctaagagtg

SEQ ID NO: 413522 - DNA, 764 bp, Homo sapiens
atattatgctcagtgaaagaagccagacactaaagcttatatattgtatgattccatttatgtgaaatgtccaaaattgacaagtctcatagagacagaaagtagaaagcctagggctgggccattggtgaaagacttgaagggtgttggggagtaactcctaattagcacagggtttctttttggggtgatgaaaatgttctaaaatttcttctttggttttttcactgccttttccttacaaggtgaaaaatgttctaaaactgattgtggtcatcgtcgcacaactctgtgaatgcgctaaaagccgctgggcattacactttcaatgcgtgaattgtatgggatatggaatacaagaaatatgttatggccaggtgcagcggctcatgcctgtaatcccagcgcttcggaaggccgaggtgggaggatcatgtgagctcaggagttcgagaccagcctgggcaacacagcaagaccctgtctctattttattctatgttttaaaatttaaaaattaaaaagaaaaaagaataacattttataagaaaatattttatgagagacttataaaagagacattaagaatatgaagtaatatatttcgtattccttatctcaataatgctgtagggaaaaaacaattgaaataaaagcagtaaatgagtggagcatggagagtgtgtcatgagccaaaggttataataaattcataatcaagtttttttgtatctgaagtctaataaaatttttaaatgtggagg

SEQ ID NO: 413523 - DNA, 1694 bp, Homo sapiens
agccatcccggcggctaaggagagcgggcaggcaaggagattccgggccaggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccctttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgataaaaaaagtt

SEQ ID NO: 413524 - DNA, 443 bp, Homo sapiens
tatgtctttgttcagttatttatttattaaacatttatggagcatccattctctgtcagtcattgtgccaaggtgctgtgcacacattttgtcagcatgaaatgagaaatcagtttgttgtagtcatccagaaaatgcttttccctaaatctgcatttagtcagattttatgtttttctgtatttgacatgttttgttttcttctttttagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgataaaaaaagtt

SEQ ID NO: 413525 - DNA, 1732 bp, Homo sapiens
  misc_feature (1693)..(1693): n is a, c, g, or t
agccatcccggcggctaaggagagcgggcaggcaaggagattccgggccaggtcgcggcggcagtcggcaagcgttcgattctctggcgttggatcgcgagcggtgtctgcttgtcccgccgagggctcccaggacagggcagggatctagggggtttgcgcacctgctttttaatgccccgcccccctttttttttttaaagtggagggggtgaaagtgagggaggagaatggacagaatactgactggaacgttaattcgagcatttcatatgcgaagagcggaataacagttccgtattcttctttcagtttctccattagattagcttcattttcgaatgctccgttttgcatgcttaattttgaaactagcccgtggtttggcagaatttgactgaattcaggggtgagagtttgatccagtccaagtgtatttgaatttgagcacgcagttcaaccagtgtttacaatggaatttctgaagacttgtgtacttagaagaaatgcatgcactgcggtttgcttctggagaagcaaagttgtccaaaagccttcagttagaaggattagtactacctctcctaggagcactgtcatgcctgcttgggtgatagataaatatgggaagaatgaagtgcttcgattcactcagaacatgatgatgcctatcatacactatccaaatgaagtcattgtcaaagttcacgctgccagtgtaaatcctatagacgttaatatgagaagtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtctgggctgcagttcctccttggaaacaaggcactctttcagagtttgttgtagtcagtgggaatgaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaatgcagcacgcgcgccggtgtaatcnatctaattgttaatattgtatgtgaaataataatgggat

SEQ ID NO: 413526 - DNA, 1003 bp, Homo sapiens
gaaaagtatacttactattcattaagtggatcatcataaagattttcatccttgttgtgttcaagttactagaaagaggaggagtaggaagaagaagggttggttttgctggtctcagaggtggcagaggcaggaaatccacgtataagtggacttgcacaattcaaacccctgttgttcaagggtcagctggattcctgtgaaggtaaatgtgcttaattgtgttcataggtttgcaagtcattgcttatttttgactgttgtcttcaaatgtaggtctctcacaaacccaaatcactcactcatactcaagctgcctctttgccatatgtggctctcacagcctggtctgctataaacaaagttggtggcctgaatgacaagaattgcacaggaaaacgtgttctaatcttaggcgcttcaggcggagttggtacttttgctatacaggtaatgaaagcatgggatgctcatgtgacagcagtttgctcccaagatgccagtgaacttgtaaggaagcttggtgcagacgatgtaattgattacaaatctggaagtgtggaagagcagttgaaatccttaaaaccatttgattttatccttgataatgttggcggatccactgaaacatgggctccagattttctcaagaaatggtcaggagccacctatgtgactttggtgactcctttcctcctgaacatggaccgattgggcatagcagatggcatgttgcagacaggagtcactgtaggttcaaaggcattaaagcatttctggaaaggagtccattatcgctgggcatttttcatggccagtggcccatgtttagatgacattgcagaactggtggatgcgggaaagatccggccagttattgaacaaacctttcctttttctaaagttccagaagccttcctgaaggtggaaagaggacacgcacgaggaaagactgtaattaatgttgtttaaataaaaatgcagtttagtgataaaaaaagtt

SEQ ID NO: 413527 - DNA, 258 bp, Homo sapiens
  misc_feature (219)..(219): n is a, c, g, or t
atgctattggtcttcgaatgccggagtgggagctgttgaacggttctaagtaggagagtgaaagaccagcatggaggagaaatccggccagttattgaacaaacctttcctttttctaaagttccagaagccttcctgaaggtggaaagaggacacgcacgaggaaagactgtaattaatgttgtttaaataaatgcagcacgcgcgccggtgtaatcnatctaattgttaatattgtatgtgaaataataatgggat

SEQ ID NO: 413528 - DNA, 451 bp, Homo sapiens
gtggttatggagctacagctttaaatatgaagcgtgatcctttacacgtgaaaatcaaaggagaagaatttcctctgactctgggtcgggatgtctctggcgtggtgatggaatgtgggcttgatgtgaaatacttcaagcctggagatgaggtgagttagggaatgccactattcctgcggggatccaacccacagaccctgatccagcgacggatgagagacgcacactgacacagatactttgcctgtcagtgcagctaaggggcttctgctccctgaatctgcagcatctgccccctaaactgacaaagtttgcatttatttagtacagattaaatgacgtaggtctcgagtaaacaccactagagggtaattaacattgccgaccgtgccctgcctctgcagcagtagagagcaatcatgcatccatgaaagatcaaagattggtc

SEQ ID NO: 413529 - DNA, 2725 bp, Homo sapiens
cgcgtcacagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactcctccgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccccagtccctgccaaagctccgatagcccccacgttccataaaccgaagctgctgaaaccacagagaaaagtcacgctgccaaagattgctgaggaaaacttaacctatgccgagctggagctgatctaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcagggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcattaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgagggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacagctggggtatgagttgtgccctctatatagctgtgtgaacttggctaaatttcttatcccctaatgacctcagactccatgtttgtgtaaagacgacttaacttcccatagaattcttgagggtaaaatgggataatgaatcttgccagttctagcaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcac

SEQ ID NO: 413530 - DNA, 2800 bp, Homo sapiens
cgcgtcacagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactcctccgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccccagtccctgccaaagctccgatagcccccacgttccataaaccgaagctgctgaaaccacagagaaaagtcacgctgccaaagattgctgaggaaaacttaacctatgccgagctggagctgatctaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcagggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcattaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgagggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggcggcgcaaaagaaatcaccccccgaggggggcaccacatataaagcacggcaccccgcgctattgttgtgaaaaaagaggggcggcacccaatagagagaggaggagatcaataatataacagccacgaagcagacgagagggcgcggcacataaaacaaaacagtgtgaagaggggagaacaacgacgcgcgcggcagcgacatccattggaggagagaaggacaaccccaccactacagcagcgggggagggcgaaagcacaaaaatatgagggagacacccaacccccacacggaaaaagatattatacaagccacccctcaggagaggaatataaaaaaaccctggagacagggtaatgaaatggcggattgaacaacaaccaggcgatgatagtctgcgtgggggcggaagaagaaatatttggcgaacgacagaaattatttgaaacagaaatatttaccccgccggggctcctttgtctctaacaggggaagaagg

SEQ ID NO: 413531 - DNA, 2771 bp, Homo sapiens
agcggactgggcccaggagagcgggggtacgatgccgcgtgcgtggcccgtagccgggagcggggacctgggtgtcggctgcgctctagcgtcatgtgcgctcgtgtgcggcgccgtcaagtgtcactagtgtcgacccggggggcgccgtggtctcagctacagcgtggaggagtgcgcacgaaaatgcgcacgtcgtccctcgtggcatggtcctcccaggaaagataggcggaaggacagcttgctggccgtgcgctggttctttgcacactcctccgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccccagtccctgccaaagctccgatagcccccacgttccataaaccgaagctgctgaaaccacagagaaaagtcacgctgccaaagattgctgaggaaaacttaacctatgccgagctggagctgatctaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcagggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcattaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgagggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacagctggggtatgagttgtgccctctatatagctgtgtgaacttggctaaatttcttatcccctaatgacctcagactccatgtttgtgtaaagacgacttaacttcccatagaattcttgagggtaaaatgggataatgaatcttgccagttctagcaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcac

SEQ ID NO: 413532 - DNA, 2357 bp, Homo sapiens
gctttaggttttggcaaggaatattttccttagcattattttcaagatattttgaaattatagttttatactaagtcatttacaaaaatttctaagtggtggcgttctagtgttgttattaatttttagaatttttttgtttccatctccacttttatatttcccttttgatcagagaccattagttacattatttttactcttcagcattaaagtttcattttagccttgtgtttagtcatttttttgtgagtgtttcatgtcaacttgaaagcaaatcacaggatctcactgcaggacgtagtgctctatagaagacaatgagatctatcttattaattatgttattggatattatgtagcctcttaaatttcttgtccacttatccctctctgaatcccaaaatgctatgaacatgcatacttgatgaatgaatgtgtgatgtagaactcctgtggtcagctagaattgtgttttgttttgttttttcttttatagccaaagattgctgaggaaaacttaacctatgccgagctggagctgatctaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcagggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcattaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgagggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacagctggggtatgagttgtgccctctatatagctgtgtgaacttggctaaatttcttatcccctaatgacctcagactccatgtttgtgtaaagacgacttaacttcccatagaattcttgagggtaaaatgggataatgaatcttgccagttctagcaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcac

SEQ ID NO: 413533 - DNA, 1197 bp, Homo sapiens
cgcgtcacagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactcctccgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacaggtaagaatattttcttccttttttcagatgaaactctttgccatttaactttcttttgatattaccaataaattgattaaatttgtagttttacctaaaagtctgcatatttgtccacaaatatgcctgcaaatgtgtatcctgcatgcatttgcatgtttccaaggtctacagtctggttttcacccccagggatccagagagcatgcagcttttgctggcccagcaggcttgctggaggaggcttggtgtatggtcctgcagagctgctccccagtttaggaaggggctcacacttgctctgaaccactttgatacattttgaccacaaacacccccaattctcttcaccaatgctgacttactgtatgccctgcttttagctggtgaggcacactttataggtaacataatagttataagagatagtgctaattcaaagcgtttactttcctgctgagtaaagctttaaaccttggaaataacataagagacaacc

SEQ ID NO: 413534 - DNA, 1153 bp, Homo sapiens
  misc_feature (36)..(36): n is a, c, g, or t
  misc_feature (66)..(66): n is a, c, g, or t
ctcctcttgccaagtgccttgcccattgcaaccttntgtgtgaattctaatgggtttgaatggggntcagggtgcatggggaagttgctctgtggacctttgggacacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgagggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacacagctggggtatgagttgtgccctctatatagctgtgtgaacttggctaaatttcttatcccctaatgacctcagactccatgtttgtgtaaagacgacttaacttcccatagaattcttgagggtaaaatgggataatgaatcttgccagttctagcaactgtaaattgctacacaaatgctctgtgttgacattcatgctaaagccagtctgcattttcaaaatgaaaatttcttcactatttaaggctttcattgcaataactttaaaaaccaaatatttgtccaccaacttagccctacagtaatgttcccaaagactcatgagagtttatggtttattggaaagggtccaaattggaagcagatattgattttctgggagcaaactggtctgcctttacaaagtggaagttcaccctctctggataacacctgtgtctcattcctccctctctgccagatctcgaaggcactgaataaaccatgcagcttttgaggaagaaagaaccatttggaagaactcac

SEQ ID NO: 413535 - DNA, 718 bp, Homo sapiens
  misc_feature (675)..(675): n is a, c, g, or t
  misc_feature (708)..(708): n is a, c, g, or t
tatccacttattcaacaacaaagcacatctaaaatggtttgaaaatgtatctgactcctttaaaatattctaataaaaacccagagatttgaaaaaatcaaaaagaatgccagcatcatctaagggagtatcttttacaccaggaaattaatagtatagtaaatttcactgataaagactccacttgaatctctagattggtaactttagttcatccaaatctgtaagcatcaaatttaaaatggtttagaaagtattttgaaattatttacttaataaattggcttctgagccagcaaagaatccactaatccagtcgcgtaattaaaccctccttttaagacccttagaaaggaaccaagacgcctagatgattgctgccaaatttaacttgggaagtcctgcagacaatgctccctaacaaagactctctgatgaacttttcaaccctggatcactcagaatcccaagaggaaacatgtcccatttccttgtattttttcttttttctttttttttgagatggaatctcgctctgttgcccaggcttgagtgcagtggcacgatctcagctcactgcaacctctacctcccaggttcatgtgattctcctgcctcggcctcccgagtagctgggactacaggctcccaccacaacacctgggtaggccggantattgggaccgactcgaatcgaatctggcatantggttcctgg

SEQ ID NO: 413536 - DNA, 332 bp, Homo sapiens
  misc_feature (330)..(330): n is a, c, g, or t
tatccacttattcaacaacaaagcacatctaaaatggtttgaaaatgtatctgactcctttaaaatattctaataaaaacccagagatttgaaaaaatcaaaaagaatgccagcatcatctaagggagtatcttttacaccaggaaattaatagtatagtaaatttcactgataaagactccacttgaatctctagattggtaactttagttcatccaaatctgtaagcatcaaatttaaaatggtttagaaagtattttgaaattatttacttaataaattggcttctgagccagcaaagaagagagagagagagagaactagtctcgnag

SEQ ID NO: 413537 - DNA, 407 bp, Homo sapiens
gcagaactaccttaccattgcatgccttttgccaactgcagaagtcatgaaaaataatttcttctcctaactccaggtttctctcatctgccaacccctccctgccccaccaccctccctcagcacacacaagtcgtaatcatcgtttgtttttcccaaagattcctgtactggttttttgcatcctcctatcacaatctgatcgttttcacgtgttacataatttaaaacgtggttttcagttaagttgctcaacaatttgcttcccatcagtagttctcaacagatagcccatctgtgggcaggagggaaggatgagaggtagtctggtaaaatagtttgaaaaatactgcccgagaggagttttctcccattttctaataagatgctcacttagaaacgggatt

SEQ ID NO: 413538 - DNA, 3035 bp, Homo sapiens
tcaactggactgtcactgcacttgaacttggaatcttataacttgaagaactgccctggagaaaggaagaaacttataataaatgggaaattataaatctagaccaacccaaacttgtactgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413539 - DNA, 661 bp, Homo sapiens
  misc_feature (45)..(46): n is a, c, g, or t
gggatggaggggcccgctagggggagaaaaagtaaagtcttaggnnacgccttggccgatgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413540 - DNA, 682 bp, Homo sapiens
tctctcccccccgttttccctctcgcccgtcacaagtccctacgccccttttctcgttcggctccacctcccccgaaacatgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413541 - DNA, 624 bp, Homo sapiens
ttttattaattttccagtgctgtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413542 - DNA, 925 bp, Homo sapiens
ccttctccatgtggcctgcattttcttataccatggctgacacaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgaccagaggttttgtgaaaatgtcgaacttgctgggtttaacgctgtgctgtcctctggatttagacaatgatggggtagattcagagaagcttgttccc

SEQ ID NO: 413543 - DNA, 868 bp, Homo sapiens
  misc_feature (846)..(846): n is a, c, g, or t
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagagctgtgatgtctgtgcacatggactatgcatatcaagatcagtttttcctccttgatattnacgtctatgactgacagtactc

SEQ ID NO: 413544 - DNA, 438 bp, Homo sapiens
agatacatgaagctcaacatgtgtattgatgagacatctatttccaatttcaatgtctattctcctcagcaacaaatccctgattttatttggggcacattgcatccagcctagaattttatttcaattaaaacatcatctgactcttacattcaagcaatggaaatacaagtaaacatgttatatgggactgtgggaagtcttcctaaaaggtaggaggtctttccttttcaccctctcctatagggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaactcttagtttaag

SEQ ID NO: 413545 - DNA, 3295 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413546 - DNA, 3471 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaaaaaaaaaaaatggcctcgttggcctcaggggcaggaaaactgcggcgcgctcgccttagtgggagggcgcattacggaagcctcggtgagtggactgggttgcgacaggacggctctgcattgtgtccgagcgagtcaacatacattcaaaggacgacaacagtggtataagcaag

SEQ ID NO: 413547 - DNA, 662 bp, Homo sapiens
atatcctccattatatatccgcgagcggaggacctgggaaaaaaaaaaaaaaatctttgatgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413548 - DNA, 3476 bp, Homo sapiens
  misc_feature (3350)..(3350): n is a, c, g, or t
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaaaacaaaataacagtcgtcttgcccggggcgacaggagataccccaataacaaaanaaatgggcctctttggcctaagggggggaactttggggccgtttcctttagggagggttattaaagatctcggtccatgactccttgccctcggcgtttggttggggaagcgttatactacctaag

SEQ ID NO: 413549 - DNA, 3369 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaaggaagacccgaattttctgaagttgtcatgaagttagaagagtgtctctgcaacattgagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaagtgctggacaatattcctctcaggtctgtctttggaggagatgaaaagaagtcttcaatacacacccattgacaaatatgatgtaacttcataaacacaaaacatagggcatcctttgaaacatttgctttgaccagaagtcttcccttttgtggctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413550 - DNA, 2306 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaactcttagtttaag

SEQ ID NO: 413551 - DNA, 2762 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagtcacaatattcttctctatgaggatgggcatgctgtggtggcagattttggagaatcaagatttctacagtctctggatgaagacaacatgacaaaacaacctgggaacctccgttggatggctcctgaggtgttcacgcagtgcactcggtacaccatcaaagcagatgtcttcagctatgctctgtgtctgtgggaaattctcactggcgaaattccattcgctcatctcaagccagcggctgcggcagcagacatggcttaccaccacatcagacctcccattggctattccattcccaagcccatatcatctctgctgatacgagggtggaacgcatgtcctgaagcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgctcactgctataacactaacatctaaagctggatgcttaagaatgtttgttgagtaaatgaatgaataccagtaaaatccga

SEQ ID NO: 413552 - DNA, 611 bp, Homo sapiens
  misc_feature (1)..(3): n is a, c, g, or t
nnnttaacgcattgcactcgacatggtctgtccaactctggtgcgcttgggaggagtgagggacacttcataccacccttgacgggttgctatgtatccgatcccatgagctcaatgcattttcattcttgccgaaatagtagcagctttgaggacagcagctgacagcattcggcgtatacctaaggagagttttttccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaa

SEQ ID NO: 413553 - DNA, 1555 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgaccagaggttttgtgaaaatgtcgaacttgctgggtttaacgctgtgctgtcctctggatttagacaatgatggggtagattcagagaagcttgttccc

SEQ ID NO: 413554 - DNA, 2405 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggattcttgatttgcagtctaaattaattattgcagtagatgttgccaaaggcatggagtaccttcacaacctgacacagccaattatacatcgtgacttgaacagatgctgtacaggatggctcagctgctaccacccagactgataaactgggtcatctggtctcctggccccaggagactgactcagcatcaagaggacaactttgacaccctatgatatcatctccaacccaaccaatcagcagtccccactttcagacccctacccaccaagttttccttaaaacccccatcctcaagtttttgagaagactgatttgagtaataataacactcttctctcctgtacagctggctgtgcgtgaattaaacttttctctattgcaattcccgt

SEQ ID NO: 413555 - DNA, 2343 bp, Homo sapiens
atgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaagaaaggagttaccccttggagttcaatatcacgtttttgtagatcctgctggagccaaaattggaaatggaggatcaacactttgtgcccttcaatgtttggaaaagctatatggagataaatggaattcttttaccatcttattaattcactctgatgaatggaagaaaaaagtcagtgaatcatatgttatcacaatagaaagattagaagatgacctgcagatcaaggaaaaagaactgacagaactaaggaatatatttggctctgatgaagccttcagtaaagtcaatttaaattaccgcactgaaaatgggctgtctctacttcatttatgttgcatttgtggaggcaagaaatcacatattcgaactcttatgttgaaagggctccgcccatctcgactgacaagaaatggatttacagccttgcatttagcagtttacaaggataatgcagaattgatcacttctctgcttcacagtggagctgatatacagcaggttggatacggtggcctcactgccctccatattgctacaatagctggccacctagaggctgctgatgtgctgttgcaacatggagctaatgtcaatattcaagatgcagtttttttcactccattgcatattgcagcgtactatggacatgaacaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatgtgaatgctcaagataatgaagaccatgtcccactccatttctgttctcgatttggacaccatgatatagttaagtatctgctgcaaagtgatttggaagttcaacctcatgttgttaatatctatggagatacccccttacacctggcatgctacaatggcaaatttgaagttgccaaggaaatcatccaaatatcaggaacagaaagtctgactaaggaaaacatcttcagtgaaacagcttttcatagtgcttgtacctatggcaagagcattgacctagtcaaatttcttcttgatcagaatgtcataaacatcaaccaccaaggaagggatgggcacactggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaagggcatgatgccattgtcacactcctgaagcattataagagaccacaagatgaattgccctgtaatgaatattctcagcctggaggagatggctcctatgtgtctgttccatcacccttggggaagattaaaagcatgacaaaagagaaggcagatattctcctcctaagagctggattgccttcacatttccatcttcagctctcagaaattgagttccatgagattattggctcaggttcttttgggaaagtatataaaggacgatgcagaaataaaatagtggctataaaacgttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggtatgggtcttttgttctgatttatccttggacattccgtagaaactactcttgcaatacttcagagggtttcccattggatgagccttcaccttttgaaatctgagtgctgctagcaagtgtgtcatttttaatatcgctaataatttatgcctaataactgtgtttcaatgaatagaaatactttatgctttcttagcagaaattcagttgaagataacaaatttaaggaatttaaattggaaactggagcttaaaataattaggctaaatttgaaatactgataaagaagatatatgtaagctcagaataaaataaacttttaaaaaagtg

SEQ ID NO: 413556 - DNA, 583 bp, Homo sapiens
acttataataaatgggaaattataaatctagaccaacccaaacttgtactggtaattattctaattattcttatttccttaagtgtaatatggttcaattatagttactgataactaacaactcattggaatatgtgttaatttgtatacggaagataaggcagcatgttttgtgaaagtctttgaaaaactatctgaactcaaattatttttttctgaagatctttataggaaacaagaaatttcttacaaaaatattattttagttccttggtataatgttacagaaaaaaatttggaatattgctgaatgtagggattttagaattatatcttaagtatctagtatttaaaaactaaaaaccgtcttgcaactagagattgctataattaaaatgcaataaaatcaaatgaaataagtcaaatatatttttctatgtaaatatattatccaatatcgaatgggttcttcattactacaattcaatatgattgcattttaaatataaacatctgcattttaaacacacaatcagtaatttaaattaagtattgtagaatctagaataaaaaacagttttga

SEQ ID NO: 413557 - DNA, 507 bp, Homo sapiens
ctcttaattcctcatttgttccctttaatattggggatggaaaaacactccacaattaaaaccacctttgcaaaaactacaactgagaaaattatgactgaaagatctgacttgactccactttgcttctaacctgcaagctgttcttgttcattcatggacataggccaaaataactttgggaggaacttgaaactaagacaataatagccctttcacaaaacaaacctctttcctgcctggggactacactaccttcataggactaacaaattagccacaagattagaaataatggtttaggaatcacatagctggagactgaaagattagaaacctccccagattgcttctggggataaatcactattgcaaaacctaagatcagtgcttgagatattttgcagatgctgtacaggatggctcagctgctaccacccagactgataaactgggtcatctggtctcctggccccaggagactgactcagcatcaagaggacaact

SEQ ID NO: 413558 - DNA, 1006 bp, Homo sapiens
tattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattctta

SEQ ID NO: 413559 - DNA, 1665 bp, Homo sapiens
tattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgttttgtattgcttcctgattaccagtctgattataccatgtgtgctaatatactttttttgttatagattgtcttaatggtaggtcaagtaataaaaagagatgaaataatttaaattcttaaatgaatcagtttttcttccctttctcctttccgtctttcctctctctgtccttccccgaaagtctactcgggtgggcaaaaatgaaaagggggaaagtgaattatgggatcggtgttttgaaagagcaatgtttattttcagtgcttttcagtttgtcaaagagtggatctcaaaatcttgcttaaagggtaattgagatgtagcagatttatttacttagtcatggaaagaaaaaaattcagtcaaaagctaaagatttccttttgattgaagacagattggttctgtggccttggaactttcccagacttaatggggaaacatcatttctagattagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaag

SEQ ID NO: 413560 - DNA, 1338 bp, Homo sapiens
tattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggccaaaggaccgtttttcacacttctagtaagcctctacctgcacgacaacacataaacaaaacacaaaatccataaccatacaaacaaacaacaacaaaaaaggggggcgctgcaaaaataacccacccgagccgccaaaaatatacacaacaccctttctttcgacaaacgcgcggcccacataaggacgccttaaaccccagcgaccaccgcgcccacacaccgatcgcatgtgaaacctcgtcgggcgcttccgaacacacccacatctggggtgacactacggccaccaccgacgatgcgccccgccaaacatcctggttaccgaacccacgcacctgcgaaactcggatgaagtagaaattacggcggaaaaaaacagcaaccgccgcagcacgaccagcccacgcgacaccacaagcacagcgataccaccactgcacgagaaacacaacacagccccg

SEQ ID NO: 413561 - DNA, 414 bp, Homo sapiens
gaggggttgatcctggacttgggagagggcaagtggagcccacccacaagacgccttcccagctgagcccgacacagcaggaacagcggggacccggccccaggtggctctgctctcagccttctcttcctaggaagggtgcgggggtatccagggccagccaggggccccgtgcccagcacatcatgagcactcagagtttattggctgagtgcctgatggactgatggactgatggacagtgggaccccagactgctcaaccctcctcagggtcccacggttcccctgagtggctctggggctctgttagaggttctgagcttgaagcttgctcctgatccccatcagagccaagagaagccccgatttatgccaactcctgcccccagcactaatcgatgctgaacgaggc

SEQ ID NO: 413562 - DNA, 307 bp, Homo sapiens
gacagggtctcgctatattgctcaggctggtctggaactcctggcctcaagtgatccacatgggcctcccaaataaacaacttttcaatacataaattttcaaaaccgagctcaaataggacctttcttaacctgagcattggaaaaattaagtcaggactgaaagcagaaaagcgactctgggaaaacgaatagaagaataaacccaaaacttaaaaagatgataaactgatggattcttaacttccaacgagaagaatgaaaatatagcagtcaacaaaatatttaatcacagatattaaacact

SEQ ID NO: 413563 - DNA, 2003 bp, Homo sapiens
ggaagacatcaggatgtaccatctgcccttctgtcggaccccagggtacgtcccatgagcgcggccgagctgcgtcgagggcagcagagcgtgctgcactgctcagggacccggactctgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413564 - DNA, 2214 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413565 - DNA, 1886 bp, Homo sapiens
gggacttgcccaatttggagcatttgggcttcaactttggccccttcctagctctcagttttctcatctgtaaaatggaagtgacagtaccgactatgaattaaatgagccattgtttgggaacttggcacgtttcccggcgcacggtatcatacatgcgctacagagggtagttattactgtggagatgacgatggctcagctggttttgcccctagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413566 - DNA, 2476 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccagcctctcttctgggctctgaggagtcagaaatagaccagacgtggttcctgctctcaggaggcttctagtctcaggagaggacggtagaagaaccatctgctgcacacagaaggcgaccaagaccccacccctttatgccatcctgacattcttggtaccttgtggggtaggcatggtggggtgtcatggctagcaccaggtaggtgggacacagagaggcaggactgaggtcacccagagtggactctggtctttcctacaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413567 - DNA, 2310 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcagagtgccccgctcctccgccccacccgcgccaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcggtttctcctgcactgttttcacctttggccagacgggctctgggaagacctacacccccccagcctggctggcatcatgcagaggaccttcgcctggctgttggaccgcgtgcagcacctgggtgcccctgtcacccttcgcgcctcttatctggagatctacaatgagcaggtaagggaatgagaggaatagaaagacagcccatgaggaaacggagcgcttctttccagggagcctggatcaaaggacagaagaggcggtggggactgttgtcagtaagatctggggatgggtggactcagaaagatccccttccctcaccctcctccctcccctcccaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaagggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413568 - DNA, 2856 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtgaagaagggagagagggaggggcccctaatgttctctgtgatcttggggtagaacccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggtggagggtacctaccccctgaggcttctccagagggtgttgggacccagatggacctgggtgaggaagggccctggagagggcaggcctcgagtctcactgctccttaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaaaaaaaaacatgcttggcccggcaacacccgcagcttgtcatactcacatacacgacagcaagggcgggggggccacttcaaaaatgatacccctcgcgggaggggccgccaaactaaggtgcgactccccccgatcatgttgtcagcaagaggggggccccccacagggggcgccacaacaaaaagacgacagcgcgcgggcgcgatccaaacacaccggcgcgtgggggcgaaacaatgcgtcactggggcaacttgtgggaaaggccccccactcaggggggggctgacccaaggcggacaacccaca

SEQ ID NO: 413569 - DNA, 1755 bp, Homo sapiens
  misc_feature (1713)..(1713): n is a, c, g, or t
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgtgagtctcacggcccagcctggaggggtgacaagtagggatgtcatggagcctctgacgcacctttttgcaggcactgccacccctctactcctgcccctgctgccacatctgcccactgtgtcgagtgcccctggcccactgggcctgcctgccaggggagcaccacctgccccagacaagtccntgggctgttcattgggcatcttacaaggggccggcaaagaag

SEQ ID NO: 413570 - DNA, 908 bp, Homo sapiens
tttactgaatcatacattcacttactccttcagtaactccccaagctccttgctttataccagcctctcttctgggctctgaggagtcagaaatagaccagacgtggttcctgctctcaggaggcttctagtctcaggagaggacggtagaagaaccatctgctgcacacagaaggcgaccaagaccccacccctttatgccatcctgacattcttggtaccttgtggggtaggcatggtggggtgtcatggctagcaccaggtaggtgggacacagagaggcaggactgaggtcacccagagtggactctggtctttcctacaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413571 - DNA, 381 bp, Homo sapiens
cgtggatactctgcgaaccctggccgcagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtaggaaaggccatggtgggagtgagggaaggctgggagaactggagaccttgatccaggagtcatcaatccagagccccagggattccagggctgcaggctagatcatggggagtgaatggctggcctagggctc

SEQ ID NO: 413572 - DNA, 2401 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcagagtgccccgctcctccgccccacccgcgccaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcggtttctcctgcactgttttcacctttggccagacgggctctgggaagacctacacccccccagcctggctggcatcatgcagaggaccttcgcctggctgttggaccgcgtgcagcacctgggtgcccctgtcacccttcgcgcctcttatctggagatctacaatgagcaggtaagggaatgagaggaatagaaagacagcccatgaggaaacggagcgcttctttccagggagcctggatcaaaggacagaagaggcggtggggactgttgtcagtaagatctggggatgggtggactcagaaagatccccttccctcaccctcctccctcccctcccaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413573 - DNA, 2546 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcgggtgagtgaagcttcgcctccgctccgcgccgggcctggcggggccccgaagcacccccagcccccaccccgggtagccgccggagtccagccacgcccttgccgcccgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtgaagaagggagagagggaggggcccctaatgttctctgtgatcttggggtagaacccaccctctccaggcctcagtcttatctctgaaatggggtgggtgttgagaggtggcttctaagatctttctacttcccaaacttggaattctctttttaggagcatctgcgtgcccagatgtatgttggagcccatggtgtatgggggtggggtggggggaagggtggagggtacctaccccctgaggcttctccagagggtgttgggacccagatggacctgggtgaggaagggccctggagagggcaggcctcgagtctcactgctccttaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413574 - DNA, 2572 bp, Homo sapiens
gacgggtaagcagatcttcagacaggttcgaggagtcctgaacagccgctaggtgcaggtatgataagtcgcattgctgcccacagggatctcgcgcggagcctggagcaagggccagaggggccggaaacgcccatccaggtggtgctcagggtacgtcccatgagcgcggccgagctgcgtcgagggcagcagagcgtgctgcactgctcagggacccggactctgcagagtgccccgctcctccgccccacccgcgccaggtgagtcctccaggcgggggtccagaagtggcgttccgcttcggtgcggtgctagacgcggcgcgcacgcaggaggacgtgttccgggcgtgcggcgtgcggcgcctgggggagctggcgctgcgcggtttctcctgcactgttttcacctttggccagacgggctctgggaagacctacacccccccagcctggctggcatcatgcagaggaccttcgcctggctgttggaccgcgtgcagcacctgggtgcccctgtcacccttcgcgcctcttatctggagatctacaatgagcaggtaagggaatgagaggaatagaaagacagcccatgaggaaacggagcgcttctttccagggagcctggatcaaaggacagaagaggcggtggggactgttgtcagtaagatctggggatgggtggactcagaaagatccccttccctcaccctcctccctcccctcccaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaagggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccagcctctcttctgggctctgaggagtcagaaatagaccagacgtggttcctgctctcaggaggcttctagtctcaggagaggacggtagaagaaccatctgctgcacacagaaggcgaccaagaccccacccctttatgccatcctgacattcttggtaccttgtggggtaggcatggtggggtgtcatggctagcaccaggtaggtgggacacagagaggcaggactgaggtcacccagagtggactctggtctttcctacaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413575 - DNA, 1638 bp, Homo sapiens
gggacttgcccaatttggagcatttgggcttcaactttggccccttcctagctctcagttttctcatctgtaaaatggaagtgacagtaccgactatgaattaaatgagccattgtttgggaacttggcacgtttcccggcgcacggtatcatacatgcgctacagagggtagttattactgtggagatgacgatggctcagctggttttgcccctagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggtctcagccgtcgaaggaactcagcccacaccctgaaccaggcctccagccgaagccatgccctgctcaccctttacatcagccgtcaaactgtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaagggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413576 - DNA, 1090 bp, Homo sapiens
cgtggatactctgcgaaccctggccgcagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccagcctctcttctgggctctgaggagtcagaaatagaccagacgtggttcctgctctcaggaggcttctagtctcaggagaggacggtagaagaaccatctgctgcacacagaaggcgaccaagaccccacccctttatgccatcctgacattcttggtaccttgtggggtaggcatggtggggtgtcatggctagcaccaggtaggtgggacacagagaggcaggactgaggtcacccagagtggactctggtctttcctacaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaa

SEQ ID NO: 413577 - DNA, 501 bp, Homo sapiens
ctgtaattaataggccctattaaaccagcccttaccttggaaaaagcagccatcccttacttcctcctagtctgtgtttccaaggtgtgtggatccttcaaaatgttggaatgaggctactttgcttgacatgattgattccagatcttgtgacccactagggttatgtttgctttttttcattatttaaagaaaaaggcaggatgaatcttcctttctgagtagtatccagcaaacaaggagacagggagttgtggccagaaggttcttaattagtaacatgattaaatcatgggaaataaccaatttacaaaaattcccagcactttccctctttacacttggtaagtatttccgggataggaaaaccgagggtgcattttgtgcttgcattggcactcccagagtggctgttaactggaatgtatactctcgatttccgctttcatatgtaggcaaggcagaggcactacaatgccttgttcatgtctgttctccctc

SEQ ID NO: 413578 - DNA, 362 bp, Homo sapiens
tttacaaatgaaccacggagcacctcagtacttagctcatacctcataccttagttccttagtacttagccttgtgccatcttgaatgagatggagtgaagtgaagctcgaaggagtgacagagacatagtccttgctctcaaggggtctttagcctggtctgggggacaagatttcctcatctacctcttgaaaggtggcaggacaactccacactggagtgttctcaccagcagataggtgctgcgggagtgtggcgccacattctttatagccacaggctttcgtggacttcccctgggttccttcctattggctggtggaccatagcggcagtgaatgtgcaaactcattcacattaa

SEQ ID NO: 413579 - DNA, 369 bp, Homo sapiens
acctgtttttctatagaaatacagcttattttgtttgtttttaatcatgtatttacagaatcctagttttgttcagtctttaaaaaaacctttctgcaaacagtttcagtgggaggtttgggtagtagctgtggtcatgccaggaaaatgtatttctttgtgagagttttggtggctgtggcttccttgtgtagtcgcagacttctttgccctccgttgtcaatttctttgcctttccattgacaacctctctggcatcttctcccacagcatgtgagacggggagctgccccggggaaatgggagggagagcgtctcctctcctgttcccagctccttgcgttgcagccttcacccacagagatcaca

SEQ ID NO: 413580 - DNA, 985 bp, Homo sapiens
cagcgggcgggcgcggcgcgggaggcgaccatgcgcggcgcgggggcgatcctgcggccggcggcgcgtggtgcccgggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagactggtagtcctgcagtcactgctatgaggcccacgtgctgcctcctgctccagattttaacctctctgtgggctgggggcacctgaccagccacaggagagggcagttcagattcattctgtatggggtccccaagccaggctaaacccagagatgagaggcacccttcccttcttccctccaccccaaagaactacaggctccagaaagtatgcagcatttattacaaagccaagagatacagatgtcccagggcaaaggagggtacagtcacaggacctcagacacaggacaaggtgcaaacacagacaagcccatcagggggctcccaacc

SEQ ID NO: 413581 - DNA, 680 bp, Homo sapiens
cagcgggcgggcgcggcgcgggaggcgaccatgcgcggcgcgggggcgatcctgcggccggcggcgcgtggtgcccgggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaaaaaaaataaaaaattcactgcccggcgttctac

SEQ ID NO: 413582 - DNA, 1338 bp, Homo sapiens
cagcgggcgggcgcggcgcgggaggcgaccatgcgcggcgcgggggcgatcctgcggccggcggcgcgtggtgcccgggtgagcacccccgccctgcaccagcccccgtcccgaaccccagccgggcccctgccagcccccactccagccccggcccggccgagcatcccggagctcccggcccgtcccgccggtgtctggcttgcctcagctcacaggcttttcccgagcgccagtccctgccaggacctccgcagccagcaccttctcttgcgacctttttcttaccctctcattcctccctcgccccttcagccctgtcacctcctccttcctagatggcctcccgtgtccttccctttccactgattttatttttccgtttccaaaccaccgtcttgtgatgcctgccatgcttgcgtaccttgcaggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagactggtagtcctgcagtcactgctatgaggcccacgtgctgcctcctgctccagattttaacctctctgtgggctgggggcacctgaccagccacaggagagggcagttcagattcattctgtatggggtccccaagccaggctaaacccagagatgagaggcacccttcccttcttccctccaccccaaagaactacaggctccagaaagtatgcagcatttattacaaagccaagagatacagatgtcccagggcaaaggagggtacagtcacaggacctcagacacaggacaaggtgcaaacacagacaagcccatcagggggctcccaacc

SEQ ID NO: 413583 - DNA, 1087 bp, Homo sapiens
aacctgagtgcctgcatggctttgaaatctccctgtccaaagctcacggtcctatggtgtcctggggaacggtcttgttgggtggcatcagatcagcctcttgtagaggaaacctgccacacacacaggccagtgggaaactaggaagggtcgcaggccggacggtgcttccagggcttgagctaaccctgagcccctcatcttccctggccacaggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccagactggtagtcctgcagtcactgctatgaggcccacgtgctgcctcctgctccagattttaacctctctgtgggctgggggcacctgaccagccacaggagagggcagttcagattcattctgtatggggtccccaagccaggctaaacccagagatgagaggcacccttcccttcttccctccaccccaaagaactacaggctccagaaagtatgcagcatttattacaaagccaagagatacagatgtcccagggcaaaggagggtacagtcacaggacctcagacacaggacaaggtgcaaacacagacaagcccatcagggggctcccaacc

SEQ ID NO: 413584 - DNA, 779 bp, Homo sapiens
cagcgggcgggcgcggcgcgggaggcgaccatgcgcggcgcgggggcgatcctgcggccggcggcgcgtggtgcccgggacctgaacccgcggcgggacatctcctcctggctggcccagtggttccctagaaccccagccaggtccgtggtggccctgaagacccccatcaaggtggagctggtggcagggaaaacctacaggtggtgtgtgtgtggccgcagcaagaagcagcccttctgtgacggctcccacttcttccaacgcactggcctatctccactcaagttcaaggcccaagagacccgcatggtggcactctgtacctgcaaggccactcagaggcccccgtactgcgatggcacccacaggagtgagcgcgtgcagaaggcagaagtgggctccccactctgagggggctgctgctgtccagccacaggtggccttggctccaggcctctgacaggcacccccttctgtgggaaaggaaacaggtgctgagcccaagagactctggtacccactgctggctcatgaaggaagaattattccttataacctaaaagtctccagtctggggcaggcgggagtgggccctggttcaatgtttgctgatggggaagatggcaaaaacaagcctgcccaaccccctttttttattttattttattttattttttagggggggcccggtcccaatttcccttttgtgaggctttttcaattcactggccctggtttacaacctctgacttggaaaaaccctgggttacccactt

SEQ ID NO: 413585 - DNA, 423 bp, Homo sapiens
acgatgtacggggacatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcaggtacaaagttaattaataaaaaaaactatgtcatatatgtaagttggtaaatgaatatgtttggctttgtatataaagtgaaatggcaaccaggatattaaataggaaatttggcaaac

SEQ ID NO: 413586 - DNA, 2495 bp, Homo sapiens
agcgggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctggggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaaaa

SEQ ID NO: 413587 - DNA, 2045 bp, Homo sapiens
agcgggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctggggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaaaa

SEQ ID NO: 413588 - DNA, 876 bp, Homo sapiens
agcgggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctggggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtaattatgctaaagaagatgtgtaggactaacattatactaaatgctggaccccaaaaaaaaaaatttttttttaaaaggaggagg

SEQ ID NO: 413589 - DNA, 273 bp, Homo sapiens
cttttgcaacaactgcaattgtaataattgttgcaacaacttgcatcatgatattgaacggtttaaagccattaaggtaataaatgtccattaaatgtatgcattttaaaagcatttcaaactgtttgagatgttcataaaatcaccttcagagattcctcattggaaaaaacccacagttttgaagaatttacattgaatacaacttgattcctgccggtgggggtattgaaccacgacaagcggctgttgtaaaagtggtaggcagagaaa

SEQ ID NO: 413590 - DNA, 2555 bp, Homo sapiens
agcgggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctggggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtactgtgactgctttgccagtggggacttttgcaacaactgcaattgtaataattgttgcaacaacttgcatcatgatattgaacggtttaaagccattaaggcatgtcttggtagaaatccagaagctttccagccaaaaattgggaagggccaattgggcaatgtcaagccccagcacaacaaagggtgcaactgcaggaggtcaggctgcctgaagaattactgcgagtgctatgaggcccaaattatgtgttcttctatttgcaaatgcattggttgcaaaaattatgaagaaagcccagaacgaaagacactaatgagcatgccaaactacatgcagactggaggtttggaaggcagccattacctgccaccaacgaaattttcaggacttccaagattcagtcacgataggcggccttcctcatgcatctcctgggaggtggtggaggccacatgcgcctgcctgcttgctcagggagaagaggccgagaaagaacactgctccaagtgcctggcagagcagatgatcctggaggaatttggaaggtgcttatcacagattctccacactgagtttaaatctaagggattgaaaatggagtagagtataaagtgtgaatgcatgttgattttgtcttagtctagaaatctctagtttagaaaggatgtttaggggaacatgaggctggctctgcagcaacaaccaggctcccctgcatccctgggcccagggagtttactcagagctctctgaagatgtggcaacccatgcccccttttctgaggaggtgcatggcctgagcattgtttgtctggcccagaggagagagcttgggttcccatagtcctgggagagtgtctgcagggcggcggaggcagagcagggcaggggagggcacagcaggccctgcgaagggcagagcggggcaggggagggcagagcaggccctgcggagagctcactctggtcgactcttcctctcagagaatgttgctctggaggctgctctgcatgaaaaccctaatggtttcttgtttgtttttcaaattatttagaaataagttctccggatgggctgttgtgataccacttaaaatctctagagaactactgaacacctaaagattttctgtagcgtagatatttccccagaggcacgcgaactgtcagtctttcctaaggcccccgggagacgcaggcaatggggcctcgcaggccaggcttgcaccagcatgtcttgagttagaggacttaaaattatccagtttcttctgtgtttctacttgaattgtggaaaagctctattatccaattaacttctccataattattgttgtaatattattattgtttgtaaaacatggttcacataactagcttgtggaaaccagcaggtaaaatgaattcttaagttgacgcttttggttctgttgtaaagcaaagatgaataaaaatttccaatgtcttcaaaa

SEQ ID NO: 413591 - DNA, 1183 bp, Homo sapiens
agcgggttcctgtccctcacccttcccccttctccaaccgccaacggccgcctgcgcctgaggcccggcccacgccccatcccgctcgctccacgctgcggcagccccggcggccccaggtgcgcggcccccgccatcccgccccgccgccctgcgccatggaggagggccctctgccgggcgggctgcccagccccgaggatgcgatggtgacggagctcttaagccccgagggtccgttcgcttcggagaacatcggcctgaaggcccccgtgaagtacgaggaggacgagttccacgtcttcaaagaagcgtacctgggcccggcggaccccaaggaacccgtcctgcacgcgttcaaccccgcgctgggcgccgactgcaagggccaggtcaaggcgaagctcgcggggggcgacagcgacggcggggagctcctcggggagtaccccgggatcccagagctcagcgcgctggaggacgtcgcgctcctgcaggccccgcagccgcccgcctgcaacgtgcacttcctgtcctcgctgctacccgcgcaccgcagcccggcggtgttgcccctggggcgcctgggtcctggaaggagcctcccacccgggcgtccgcatgatcccagttgaaatcaaggaagcaggtggtactactacaagtaataatccggaagaagcaactttgcagaatcttcttgctcaggaatcctgttgcaagttcccatcgtcccaggaactagaggatgcctcctgctgttctcttaagaaagattccaacccaatggtgatatgccaattgaaagggggcacacaaatgctatgtatagacaattctagaacaagagaactaaaagcactccatttggttcctcagtatcaagatcaaaataattatctacagtcagatgtccctaaaccaatgactgctttagtagggagatttttgccagcatcaacaaaattaaatctcattacacaacaacttgagggagccttaccatcggtagtcaacgggtctgctttcccctcgggatcaactcttccaggaccaccaaaaataactttggctgggtaaggattagaagcaatacattgtcactctaatgtaataatttaagagactcttggatacgttcacgattttcttctatactataaaatgagcttcactgcacacc

SEQ ID NO: 413592 - DNA, 415 bp, Homo sapiens
cattctctgagaatcagactaagcctcatgttcagaattgccagagttcaaacattttgtccagcctgggcaacagagcgagactctgtctcaaaaaaaaaaaaaaaattatatatataaaaaaaattaaattcagggcttatagccactaaagatcttgcaacatccagaagttctcttctggatctattatattctccttcatatcatatctactttacttaaacactagcattccagataaaattaagatgtcattttatcttacatttaaatgattattggctactattaacagaattgtatcctaatttcagatagaactatagaatattttagaatcttttgtaaataactttaagagcagcctaggaaccctgtcatcatttatacttcttaaaaattagaaaactgt

SEQ ID NO: 413593 - DNA, 386 bp, Homo sapiens
agtctaaggaggttcatgtctcacaaaaggttagtagtcactgtattagaagggtccatttccagtcagatgaattttacatgaaaattttgtgtctttctaaagtggagagatagtggtcacctcgctaaataacataaggtactagacacatgggaattcagagatgccagtttgctgttacccaaattgtcatttctccaaagaaaacctttctctcaacatcaggaagcaccttttaaattaaagcacttcactgccccaccttagcaaagagagaaatgaaaaccaagctgcaggccgaggttcccatcgtttgaaggaacccgacagcccaaggctagcattactcatttccaggcagtgggatgtggccttagctgtga

SEQ ID NO: 413594 - DNA, 1403 bp, Homo sapiens
aggaaatgaagaaacacaggagctttctctctctccatgctcaggtactgaggaaagatcatatgagcacacagcaaaaaggggccttttagaaaatctcacaccacttcctagttggagcaattaaacaatagagaagatgggtattctggagcagaatttaatgaaacagaactccaccatctatggcaagtttgactgcttgagtctccagaggataatagttggaggccactgaggcccaaattcatcagtccggccattgaaggacacaagtgaacaaaggaggacggcaaagacagaactgtgatattcaaacactcaatagctcacagtgtcggggttcattatgacacttactaagcacatgccatatttctgacactgtgctaagagtttcatgaacattaactaaattaaccccataaaaacgccattagaaagatgcagttttgtacccccttacacagatgaagaaaataaagtatagagactttaagaaatttgccagaagtcttataactgattggtttgccatggctctttgaacagttactcttgtcctcattgtagagatggcgatactaaggcagaatatggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaaaaaaaaaaattcggccttcttggcctcagcgggtggaactctgcggccgctttcctttatgaggttattcatg

SEQ ID NO: 413595 - DNA, 942 bp, Homo sapiens
cctctcatgatcatgacacgtagtggaaattttcctggcttctatacatcatcatctctgcctgattggtttgccatggctctttgaacagttactcttgtcctcattgtagagatggcgatactaaggcagaatatggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaaaaaaaaaaattcggccttcttggcctcagcgggtggaactctgcggccgctttcctttatgaggttattcatg

SEQ ID NO: 413596 - DNA, 1330 bp, Homo sapiens
aggaaatgaagaaacacaggagctttctctctctccatgctcaggtactgaggaaagatcatatgagcacacagcaaaaaggggccttttagaaaatctcacaccacttcctagttggagcaattaaacaatagagaagatgggtattctggagcagaatttaatgaaacagaactccaccatctatggcaagtttgactgcttgagtctccagaggataatagttggaggccactgaggcccaaattcatcagtccggccattgaaggacacaagtgaacaaaggaggacggcaaagacagaactgtgatattcaaacactcaatagctcacagtgtcggggttcattatgacacttactaagcacatgccatatttctgacactgtgctaagagtttcatgaacattaactaaattaaccccataaaaacgccattagaaagatgcagttttgtacccccttacacagatgaagaaaataaagtatagagactttaagaaatttgccagaagtcttataactgattggtttgccatggctctttgaacagttactcttgtcctcattgtagagatggcgatactaaggcagaatatggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaa

SEQ ID NO: 413597 - DNA, 1148 bp, Homo sapiens
tacattaattttattaatatacttttcttctttgaactattcagattggtttgccatggctctttgaacagttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtcaaggacatgaaagaaagacatgttttctaacaaaacagaaaaaaacaaaaataagaacagaatgcttttaacattgcttaaagaactacagaactatggtggcaaagctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaaaaaaaaaaattcggccttcttggcctcagcgggtggaactctgcggccgctttcctttatgaggttattcatg

SEQ ID NO: 413598 - DNA, 1166 bp, Homo sapiens
tacattaattttattaatatacttttcttctttgaactattcagattggtttgccatggctctttgaacagttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtcaaggacatgaaagaaagacatgttttctaacaaaacagaaaaaaacaaaaataagaacagaatgcttttaacattgcttaaagaactacagaactatggtggcaaagtgagtatgtcatacaaggctagcctggacttctttttgtggagactggattccaagattgaaagtagaagctacatgttttctccaagcagggctttcagacttcacttctgcaacattttattgatgaaagcaagtcacaagaccagactgattcaaggggtggagaaatagaccctacttcttgatggagggaggagtagagttacattgcaaagggatctggacaaaaaaaggagtgatttattaggaatcatgtttaacaatttaccacaatccccagcgcaactgcctgttagctggatccagaaatgtctacgactactgcaatgccacttggccttaggggtgatgtgacccagtgtaaagagatggtggtcttaaccaatcacagttaagatagtttagttttggaaggtataaaaaatatgtaacaacatgaatgcacttttagggtcagacaagagacttggaaagagcctgcaaaatggaggagccctgaggcctaagtctcatgagtgtcaatgcttacctgtatctagacactggcatcccccttttgataaggccaagattgattgttttccttttctacctaccctatatctaatccatgtacaaacactgttgacacacaaaagaaccctaaattcaacaatctgtgaagaatttttgcactaacatgttagttcaaaaactcaacattgcttgctaagactattgcaataaactcctctatgatcccctaaaaaaaaaaattcggccttcttggcctcagcgggtggaactctgcggccgctttcctttatgaggttattcatg

SEQ ID NO: 413599 - DNA, 942 bp, Homo sapiens
  misc_feature (942)..(942): n is a, c, g, or t
tcaaggttaagtaaagggcactgaacaagtgaagctgtgctgaaaacaacagtggccaaggcagagatattcttatacctcaacccgttgtgcagatggaagtctggccaaaaaaccataaagcatcaagtctgactattggtttgccatggctctttgaacagttactcttgtcctcattgtagagatggcgatactaaggcagaatatgtttctcttgctcatcggaccaaagtttggaatcacgtctcatcttcgtgtattttgaaaatctaacaaatctagaagatggtgtgaatgtgcatatatttagacaatttaaaattttgtcaaggacatgaaagaaagacatgttttctaacaaaacagaaaaaaacaaaaataagaacagaatgcttttaacattgcttaaagaactacagaactatggtggcaaagtgagtatgtcatacaaggtaggctatgtaaatctatgtgtgataattgtgtactattcattgataggggatgtactttctacttaacacatgttctcctcctagataccttacctataggtacagaagtatctattatattggtttaggctgattctaagggatatttctcttaatgtaagctgaagcagagagaaactctattggcagatgcaagtgacttttttaacacaatgagttactgaaggatggattcttaagctatggaatattgctgaaatcaaagctgctataatgcagttatactttcataagtctgaatagaaaaaaaagtcacatcatggaaaagagaactcaatcaaatattggacttccacactatttatgtggactatgtgtacctatgtggtcttaataaatattctcataaatacctgcaaaaaaaaaatcggctccgtggccccagcggggagccttcgcgcccttccccttaacgagggttaan

SEQ ID NO: 413600 - DNA, 526 bp, Homo sapiens
attggtttgccatggctctttgaacagttactcttgtcctcattgtagagatggcgatactaaggcagaatatggtaaggtaatttattcataatttccgagaactctataccctgtcaacttcaaattacaaatcatagtgcacgctggggcatatgttgggcttccctttgattaacagggaggaggttgggcttgatgacctctgcaggaggcttccagctctgtaatactaggatcttaattctgacgaatggtcctgatggtaactagaaccaagctactcccccaccctttagttcaaaacttaagacaaatcacacactcatgcaaaatattttttctccctactaattcatagggtaaaatatcaatttctgctaagcattgttatgttctgatttagtcatgagtgtgagttgatgaaaggacctatcttatttacactgttgtttggaaattctacggggattttgaactgggggaaggacacagcgggaagtttggttccagctcagtgaatgac

SEQ ID NO: 413601 - DNA, 1789 bp, Homo sapiens
  misc_feature (272)..(272): n is a, c, g, or t
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatganggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtc

SEQ ID NO: 413602 - DNA, 1679 bp, Homo sapiens
  misc_feature (272)..(272): n is a, c, g, or t
atggcttgccttggatttcagcggcacaaggctcagctgaacctggctgccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatganggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtc

SEQ ID NO: 413603 - DNA, 1266 bp, Homo sapiens
cttacacctcagtagtacttactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtc

SEQ ID NO: 413604 - DNA, 571 bp, Homo sapiens
ttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 413605 - DNA, 522 bp, Homo sapiens
gccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggaga

SEQ ID NO: 413606 - DNA, 2806 bp, Homo sapiens
tgggttggtgtttatctcctcccagccttgagggagggaacaacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattc

SEQ ID NO: 413607 - DNA, 1019 bp, Homo sapiens
ttttttttaaagatagggaggagacgacaaacatttaggaatcaggtttccggtcatttgactaatgactgccttctaacactgttcttttctagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtaagtaatgccacataaagcacacggtgtccctgcagctagagactagcactcagtcgcgtcaggagcttcctcaatgaaggcatgagaaactaaagaaagcaccaccacaggagaaaaggaatgaattgataagaaattaaggatgtatggctgcttatgaattaaaaatcagtaaatctgtttttgtatttaatactgaggttaaatttcatgtgttctatctactgaagacatgtgagtcattttcatgccacgcatcccaaccactgcaagatgaataccccctctgtctccctggtgctttctggactccgggaatcattttccatttctaagtcctaaagtctttgaacatttgagaaatgaaaagcactgaggcaaagagctagaaactctggccttaaatctaactcttgagttaagataaaacctgaatctcaacagctaacacagcctgtggaatgagtttatggagaaggagacaagtgggacagtgagaagcgtctagccacagaaaagatggtgctacgcccgagcaagagccctgagcgctgccatggctccaggtccgccactaaccaaataaatgcatcacaatgaggcactcaccttttctgggcctcaaataatataaagggttgggccagacaagtgattgctaagttctctttccactgtgagattctatgagctagtgattaataataacagaaagaagactgaaatagtcaactagtggccaggcgcagtagctcacgcctgtaa

SEQ ID NO: 413608 - DNA, 2348 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgc

SEQ ID NO: 413609 - DNA, 2776 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaaggtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattc

SEQ ID NO: 413610 - DNA, 2264 bp, Homo sapiens
ttttttttaaagatagggaggagacgacaaacatttaggaatcaggtttccggtcatttgactaatgactgccttctaacactgttcttttctagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtattaaatcagaccacgagacttgaacttcagctcttggaacactccctctcgacaaacaaattggaaaaacagattttggaccagaccagtgaaataaacaaattgcaagataagaacagtttcctagaaaagaaggtgctagctatggaagacaagcacatcatccaactacagtcaataaaagaagagaaagatcagctacaggtgttagtatccaagcaaaattccatcattgaagaactagaaaaaaaaatagtgactgccacggtgaataattcagttcttcaaaagcagcaacatgatctcatggagacagttaataacttactgactatgatgtccacatcaaactcagctaaggaccccactgttgctaaagaagaacaaatcagcttcagagactgtgctgaagtattcaaatcaggacacaccacaaatggcatctacacgttaacattccctaattctacagaagagatcaaggcctactgtgacatggaagctggaggaggcgggtggacaattattcagcgacgtgaggatggcagcgttgattttcagaggacttggaaagaatataaagtgggatttggtaacccttcaggagaatattggctgggaaatgagtttgtttcgcaactgactaatcagcaacgctatgtgcttaaaatacaccttaaagactgggaagggaatgaggcttactcattgtatgaacatttctatctctcaagtgaagaactcaattataggattcaccttaaaggacttacagggacagccggcaaaataagcagcatcagccaaccaggaaatgattttagcacaaaggatggagacaacgacaaatgtatttgcaaatgttcacaaatgctaacaggaggctggtggtttgatgcatgtggtccttccaacttgaacggaatgtactatccacagaggcagaacacaaataagttcaacggcattaaatggtactactggaaaggctcaggctattcgctcaaggccacaaccatgatgatccgaccagcagatttctaaacatcccagtccacctgaggaactgtctcgaactattttcaaagacttaagcccagtgcactgaaagtcacggctgcgcactgtgtcctcttccaccacagagggcgtgtgctcggtgctgacgggacccacatgctccagattagagcctgtaaactttatcacttaaacttgcatcacttaacggaccaaagcaagaccctaaacatccataattgtgattagacagaacacctatgcaaagatgaacccgaggctgagaatcagactgacagtttacagacgctgctgtcacaaccaagaatgttatgtgcaagtttatcagtaaataactggaaaacagaacacttatgttatacaatacagatcatcttggaactgcattcttctgagcactgtttatacactgtgtaaatacccatatgtcctgaattcaccatcactatcacaattaaaaggaagaaaaaaactctctaagccataaaaagacatattcagggatattctgagaaggggttactagaagtttaatatttggaaaaacagttagtgcatttttactccatctcttaggtgctttaaatttttatttcaaaaacagcgtatttacatttatgttgacagcttagttataagttaatgctcaaatacgtatttcaaatttatatggtagaaacttccagaatctctgaaattatcaacagaaacgtgccattttagtttatatgcagaccgtactatttttttctgcctgattgttaaatatgaaggtatttttagtaattaaatataacttattaggggatatgcctatgtttaacttttatgataatatttacaattttataatttgtttccaaaagacctaattgtgccttgtgataaggaaacttcttacttttaatgatgaggaaaattatacatttcattctatgacaaagaaactttactatcttctcactattc

SEQ ID NO: 413611 - DNA, 1687 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcttgagaattatatccaggacaacatgaagaaagaaatggtagagatacagcagaatgcagtacagaaccagacggctgtgatgatagaaatagggacaaacctgttgaaccaaacagctgagcaaacgcggaagttaactgatgtggaagcccaagtaagtaatgccacataaagcacacggtgtccctgcagctagagactagcactcagtcgcgtcaggagcttcctcaatgaaggcatgagaaactaaagaaagcaccaccacaggagaaaaggaatgaattgataagaaattaaggatgtatggctgcttatgaattaaaaatcagtaaatctgtttttgtatttaatactgaggttaaatttcatgtgttctatctactgaagacatgtgagtcattttcatgccacgcatcccaaccactgcaagatgaataccccctctgtctccctggtgctttctggactccgggaatcattttccatttctaagtcctaaagtctttgaacatttgagaaatgaaaagcactgaggcaaagagctagaaactctggccttaaatctaactcttgagttaagataaaacctgaatctcaacagctaacacagcctgtggaatgagtttatggagaaggagacaagtgggacagtgagaagcgtctagccacagaaaagatggtgctacgcccgagcaagagccctgagcgctgccatggctccaggtccgccactaaccaaataaatgcatcacaatgaggcactcaccttttctgggcctcaaataatataaagggttgggccagacaagtgattgctaagttctctttccactgtgagattctatgagctagtgattaataataacagaaagaagactgaaatagtcaactagtggccaggcgcagtagctcacgcctgtaa

SEQ ID NO: 413612 - DNA, 844 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagggaaaaaaatccatctgtctttgtgaacatgctattaagatcagcttggcagcagctcaggttttaacaaccaaaaaaaaa

SEQ ID NO: 413613 - DNA, 865 bp, Homo sapiens
ctggttggagggcaggcattctgctctgatttttcctgttgcctggctagtgaccccctacaggaagataacggctaagccaggagggcggagcagcccactacacatgtctggctgctcttatcaacttatcatataaggaaaggaaagtgattgattcggatactgacactgtaggatctggggagagaggaacaaaggaccgtgaaagctgctctgtaaaagctgacacagccctcccaagtgagcaggactgttcttcccactgcaatctgacagtttactgcatgcctggagagaacacagcagtaaaaaccaggtttgctactggaaaaagaggaaagagaagactttcattgacggacccagccatggcagcgtagcagccctgcgtttcagacggcagcagctcgggactctggacgtgtgtttgccctcaagtttgctaagctgctggtttattactgaagaaagaatgtggcagattgttttctttactctgagctgtgatcttgtcttggccgcagcctataacaactttcggaagagcatggacagcataggaaagaagcaatatcaggtccagcatgggtcctgcagctacactttcctcctgccagagatggacaactgccgctcttcctccagcccctacgtgtccaatgctgtgcagagggacgcgccgctcgaatacgatgactcggtgcagaggctgcaagtgctggagaacatcatggaaaacaacactcagtggctaatgaagcaaagggaaagtaaattactaaatgcaaccgtatttaaaacaggaggaaggagaatccgcaggaagttggaatctaggataaaaacttagacacattcagcc

SEQ ID NO: 413614 - DNA, 520 bp, Homo sapiens
actcaccaaatgattggctgttgaaataacaagtctttgtgttttcatgaactccgtttaaatgccttactattttttaaaagcagctaaggaccccactgttgctaaagaagaacaaatcagcttcagagactgtgctgaagtattcaaatcaggacacaccacgaatggcatctacacgttaacattccctaattctacagaagagatcaaggtgaggtattcgtctccccttactaactccctggctctaggcaggccactttagagagtgaggaaccagagagcagaagtctctccccaaagatcttccccagcctcacacagtacaaagccatagttactgggcagctacctcgcctagagtgcttgccaagggctctaagtgccgctgctgtgcagaaaatacaaaagctgcatatgaatgatgtagaaatgtctatcttatcttcggcaagaaatacattctccttgcattttgcttgaataatgcatactgtcagttgtttttcctgaggtg

SEQ ID NO: 413615 - DNA, 329 bp, Homo sapiens
caaacgtcaggtaattctatgattagaattgtgtcgtgatactttgtgggtgaagacagtcccaaaccaaaaatgatgagacaagtgaaatctttattaaggaaggcctaacagctgtatcagataagtttgctttttcttggaaactttggtaaaaaaaaaaaatcacctgggaaataatgtgattagagatgcttcttaaatgtgcatatgtgtttagtctgttctacaaagatattattttctttgtagcattgttttattgaacaaattttgttaaattttctattaaaatagtcttatagtgatttaataacaatttggaaaag

SEQ ID NO: 413616 - DNA, 506 bp, Homo sapiens
ggatttaacaaaggaccgagaagtcggctgaatagccaggttcagacagtgttggcaagaacggatctttggcaagatcacttaaggtgagctactctagcagcatcctgtttgacatttgtatccataacttgaataaaaatatagaaggcaaagaagagtgctgggcaagatgtgttgggtgttagatctgcaatactcttcatagtgtaatggctaaatgtaaagtcttacgtctcggttcaagaaagcacgttgctatatgaaatttcagaaaaaagttttgttgcggggggtgggatattgatcatttgaacatatgccagttgtttctcctgccctaggggaggttggcacggcaaccttcccactctgtaggtgggtagccttgctgatggggcacgtcgtcaccaagggacctgattgttgtcatggttttgtcttgtcctcctccctggtgaaagtctactgcagttttattctcagctctggagggagagggaacg

SEQ ID NO: 413617 - DNA, 589 bp, Homo sapiens
tgaatacttagattcggacatttaaatcctttgtctgctgtcttttattgatttcagtcagagtttaaatacatttcatactaaacatagcaatactcgataaaagactagcaagctgatgctaaatatagtgaatttacccctatggcttcaatatttgacgtattgtgaatgttagtgctagtctaaatgttgttgggtgaatgaatgaaagaataaataaatgagtgaataaaaatgtggcaaacatgttgtatgagcaatagagcaatatattattaataccaattatagatgttcttggctgaatttcttttgtgtttgttgataatattaagtggcatccctgcactatattaaaaacttagcaaactgtcataaaatgcatactaagtgtcaagtaagcgtagaatgaccaagggaattcaaagcacattagacgaggacacttgcatctgaagaactcctaatctttttcagacattgaaagcttattatggcccagtgcagtggctctcgcctataatcccagcactttgggaagccgaggtggctggattacctgaggtcaagagttcgagaccagcct

SEQ ID NO: 413618 - DNA, 363 bp, Homo sapiens
ccgatgtggtccctgcccttgtttacagcatgcacagctgtctgtgttttagcctattttattactcttcctcacccccacttaactgtgagctctttgaagacacaaacagttttctccttgatgcctgatcaaaatagatacttcaaaatccttttgttaaaaacgcaattctaggccgggtgcggtggctcatacctgtaatcccagcaccttgggaggccgaggtgggtggatcacaaggtcaggagatcgagaccatcctggctaacacggtaaaaccccatctctactaaaaatacaaaaaattagccgggcgtggtggcgggcgcctttagtcccagctactcaggaggctgaggc

SEQ ID NO: 413619 - DNA, 1278 bp, Homo sapiens
cccaagctggagccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413620 - DNA, 731 bp, Homo sapiens
agtcactcgacaggattatacttactcagctgttaagagtaggcaaaaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413621 - DNA, 443 bp, Homo sapiens
aaatatttcactcattcatctgccttcttttgctttggtgttgctgagtcaagtatctttcttgcagaggcattatgttcattcaaaacatgttgttttcttctctctctcttttttttttaaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413622 - DNA, 618 bp, Homo sapiens
  misc_feature (605)..(605): n is a, c, g, or t
cccaagctggagccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccagtctctgtctgccgctctccgcggtctccctctgttaccgaggctggactgtactgacacgatctcggctcactgcaacctccctgcctgattctcctgcctcagcctgccgagtgcctgggattgcaggcgcgcgccgccacgcctgactggtttttgtattttttggtggagatggggtttcgctgtgttggccgggctggtctccggctcctgaccttgagtgatctgcctgcctcggcctcccgaggtgcccggattgcagacagagtctcgctcactcagtgctcaatgttgcccaggctggagtgcagtggcgtgatctaggctctctacaacctccacctcccagctgcctgccttngcctcccaaagtg

SEQ ID NO: 413623 - DNA, 413 bp, Homo sapiens
  misc_feature (406)..(406): n is a, c, g, or t
gggcagacatgctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaagctaaagaatccctgaaacaggctgtctgcttcacggtgtatcgcgccatcgggatntctagag

SEQ ID NO: 413624 - DNA, 272 bp, Homo sapiens
  misc_feature (58)..(58): n is a, c, g, or t
aatcttttttcctcctagtataagaccaattgccattaaatacgaccttcagctaacnatccctgagctagctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413625 - DNA, 1298 bp, Homo sapiens
cccaagctggagccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaaaaaaaaacaaaaaacaagag

SEQ ID NO: 413626 - DNA, 1194 bp, Homo sapiens
  misc_feature (65)..(65): n is a, c, g, or t
ggtgaggcgcagaggatgctccacaggggcctctggccttggtgcacgcggttgttgccgacccnctgggaccatggctggcccagtggacgtccctgtgtgtgcggcttgctcgacctcctgaacacacaagggttctcggcgtgtagaacgcatgctgttggtagaatcgtgatacatacatacgcagttcatcgacgcgattttagtgccgtcgtgtgcacaccgtgagtcaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggtgggtgtactcctgggatatcatggagccagttacatacttcatcacatttgcaaattctatggtcttttttgcatactttatagtcactcgacaggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413627 - DNA, 1181 bp, Homo sapiens
cccaagctggagccgcggcgcgctgagcgagcaggcggggcgggagcgcccacagctcggagccaccaggcgctgacgaggagcccggctgagggaggatgcgccgctgacgcctgcgggagccgcgcgcctggggcgggaggatgctccagaggggcctctggccgtggcgcacgcggctgctgccgacccctggcacctggcgcccagcgcgcccgtggccgctgccgcctccgccccaggttttgcgtgtgaagctgtgtggaaatgtgaaatactaccagtcacaccattatagtaccgtggtgccacctgatgaaataacagttatttatagacatggccttcccttggtaacacttaccttgccatctagaaaagaacgttgtcaattcgtagtcaaaccaatgttgtcaacagttggttcattccttcaggacctacaaaatgaagataagggtatcaaaactgcagccatcttcacagcagatggcaacatgatttcagcttctaccttgatggatattttgctaatgaatgattttaaacttgtcattaataaaatagcatatgatgtgcagtgtccaaagagagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggtgaaagctggaatagaagctcattcggaagccaaaaccagtggactcctgtgggctggattggcactgctgtccattcagggtggggcactggcctggctcacgtggattatacttactcagctgttaagagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413628 - DNA, 226 bp, Homo sapiens
gcatacatttaattttaattaaaagctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgtttaatctttgttattaaattcttgtaaaacagaa

SEQ ID NO: 413629 - DNA, 469 bp, Homo sapiens
ttttaccttgtatatgaactgctcttcagatccacactttgttgtttactgtgactctctttgttgaaaagtacacttgaactgcttttcaaatgtatattacacctttgtttacatgtttgtacaccagcttccttaccctgtggatcctaagataatatttggaaagagaattggggaccgaaagatttacacaccctgcgggaacaatgtggtgactggcttgtttcccttgtgtcttttctcagaaaaaccaagtaatgagcacactgctgagatggaacacatgaaatccttggttcacagactatttacaatcttgcatttagaagagtctcagaaaaagagagagcaccatttactggagaaaattgaccacctgaaggaacagctgcagccccttgaacaggttaggaagcatcacggttgagtatatttgaaaataatacctagtgtttattgagtgctc

SEQ ID NO: 413630 - DNA, 316 bp, Homo sapiens
ttaaaatgttttatggattaaagaataaattatacattcagcattaaacgaatacttagaactgactgagaataaatatattatgtgtcaaacacatgtgagatatagcataaagcagtatgtagaggtaaatttatcaccttaaatgtataccttagaaaagaagaaagattgaaaagagccaaaattaatgaatcaaaaacaatttaaaaaataagatccataaagcctaaaaacagttatttgaaaatatttctaaattgagtaaaaatctaggcaaagtaattgcctaaaaataaagaagatacacatttct

SEQ ID NO: 413631 - DNA, 553 bp, Homo sapiens
cgaataagtttattttgtctggagtgactgaggaaatgccctggagagtaccaagagaacagcaaagtccctgtggagcatagagtcaagaatagctccacagggaggagaccaaagtatcctgcctctgccatactgtctcccctgcgaggattgaatcaaagccagggggttcctcttcttataggaagaaggtaagcggagaatcatcagtcctcatcaccaccacaggtgccagcagtcactgctacaagagagttccccagtcctcacaggtcccaagtccagcatgaacagttgctgaaagtgcatgtggctacattcccccacagcaggaacctctttgacaccctgcacccctgcaatccaagcagctaagggatgacacaactgtgaaaccaagcccacatctggagtgcttcctgacctggaggccagtagccaccctgtatcccagaggcattgccctcattccacaaagttcacacaagtgcctctagcactaataccttggctacttggagcctaggctcaaaggcacaactggggccct

SEQ ID NO: 413632 - DNA, 342 bp, Homo sapiens
cagatgtcagtttttaatgagaatttcaagtatttatattttaaaagtaaaccagaggaagattgagttatgaaaagattgaattgtagtcatacagacctaggtctgaatcttggctctgccacttaccagctgtgtggcctgggcaagttccttaacctccgtgagccgcagtatgtttgtctgtaaagagagataagtttgtttatcctattggattgttcttgagcattaaatgagataatgtgtaaagtaccgcatagtaattgatcgataaatagtagctaatgtcactgaatgattaataaatgcttatggaactgaagcaatctttagcaataa

SEQ ID NO: 413633 - DNA, 341 bp, Homo sapiens
gtctgggccgggcgcggtggctcacgccttaatcccagcattctgggaggccgaggcgggcggatcacgaggtcaggagttcgagactagcctggccagcatggtgaaaccctgtctctataattttttgtattttgtagagacagagtttcaccatgttggtcaggctggtctcgaactcctgacctcaggtgtggaattttaaacctggctctgaaggggatagacccctgttcaccccgtccagattttatctcaaatcctagcattgtacaggcttaggagacaactggaccagttcttgctccagagtgccagatccacacatccaatcatttatt

SEQ ID NO: 413634 - DNA, 327 bp, Homo sapiens
gcgcgcggcgggcgtaggactttgggctttcgcctcgtcctgcgcttgaccccagatgcgtttccagaagcggggcacctggggacgcaggagtctgggatccccgtcccccgaaaacggacttggctccgagaaatcctccgcttcgtgggcttcgcctcgaactcctgacctcaggtgtggaattttaaacctggctctgaaggggatagacccctgttcaccccgtccagattttatctcaaatcctagcattgtacaggcttaggagacaactggaccagttcttgctccagagtgccagatccacacatccaatcatttatt

SEQ ID NO: 413635 - DNA, 264 bp, Homo sapiens
gcaaactgggacctccctcagctctgccctcctaataagaccatcctgacacaaagcagcaattattctttgatgacatcaccaccgtcttgcccttatttttatgtgcataatggaagatttcaactttaaatctgacctagccatgaaagtcagtgtgagtcctgcatcatgttttcatcctgctatgtttttactttctggtagtgcttttaacacagagagtttccaacttgaaatatagagaccttttaggaagttttt

SEQ ID NO: 413636 - DNA, 847 bp, Homo sapiens
ccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatctggcttgccagaagcggccctctggaaaactggtgtctgtgctcagtggggctgagggatccttcgtgtcctccctggtgaggagcattagtaacagctactcatacatctggattgggctccatgaccccacacagggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatacttaaatgc

SEQ ID NO: 413637 - DNA, 709 bp, Homo sapiens
ccatccctgagatctttttataaaaaacccagtctttgctgaccagacaaagcataccagatctcaccagagagtcgcagacactatgctgcctcccatggccctgcccagtgtgtcctggatgctgctttcctgcctcattctcctgtgtcaggttcaaggtgaagaaacccagaaggaactgccctctccacggatcagctgtcccaaaggctccaaggcctatggctccccctgctatgccttgtttttgtcaccaaaatcctggatggatgcagatggctctgagcctgatggagatggatgggagtggagtagcactgatgtgatgaattactttgcatgggagaaaaatccctccaccatcttaaaccctggccactgtgggagcctgtcaagaagcacaggatttctgaagtggaaagattataactgtgatgcaaagttaccctatgtctgcaagttcaaggactagggcaggtgggaagtcagcagcctcagcttggcgtgcagctcatcatggacatgagaccagtgtgaagactcaccctggaagagaatattctccccaaactgccctacctgactaccttgtcatgatcctccttctttttcctttttcttcaccttcatttcaggcttttctctgtcttccatgtcttgagatctcagagaataataataaaaatgttactttatacttaaatgc

SEQ ID NO: 413638 - DNA, 831 bp, Homo sapiens
aaccttagaggttaacctttgaggaggaagggcgaacctgaataaagtgacaggttatgtagaaagtgatttttctttccacttgggcatttgggggaagctttaaaaaacattgtagtgtagccatattgtttcacagaggaagcataagctttaaagccagaaagacctgacttgggtactgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacacatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttg

SEQ ID NO: 413639 - DNA, 560 bp, Homo sapiens
  misc_feature (374)..(374): n is a, c, g, or t
gaaagatgatgaaagcacattgaagatcctcctaatggatagaatgttgacacttggattaaaaaggtgacttggcgttttctgcatacacctccccccacaactccccagacctaacctgcgtccccactctgcccaccgcacctgccttgctttaccctctttgcccctttcaaattactggtaccatccttcaactcgccctccttccagttgaaattattatcccctcttcactttgcaaaattctaactgcattccagccttgcgatacagagaaactgtctcaaaaggaaaaagattgttctcctaaaatctttagatttctagataggatctgttgattattcaataaattgggggggtactatagnggtatggcaaagggagattggggctagcattgtctgttgggggaaggctctttctgctctagcagccctctgataaatacctccttgtctggtccctgacctactatgactgcatgctttcaacataatttgattgctagtcagtgcttactcagggtctttcatgtgtaacacttaggttgcttt

SEQ ID NO: 413640 - DNA, 159 bp, Homo sapiens
tgacatcctaggctccagcaatcctcccacctcagcctcctgagtagctaggaccacaggtgtgcaccaccatgcccagctgcatgtttttttgttttgttttgttttgctgttgtagagagttggtgtctcactatggctatgttgcccaggctgatc

SEQ ID NO: 413641 - DNA, 404 bp, Homo sapiens
gctacgacaggacagagacgctggctaggccgccctccccactgttaccaacatgaagctgctcgcagcaactgtgctactcctcaccatctgcagccttgaaggaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413642 - DNA, 613 bp, Homo sapiens
tttttttttgcagacagcacgtactattttattgggcctcaaaagctttaaatacagaatgggctggccagagcgaagatgtgaacacactggcatttgagaatggacgtatcagaaaaatcacataatcaacagttggaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413643 - DNA, 533 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413644 - DNA, 620 bp, Homo sapiens
  misc_feature (172)..(172): n is a, c, g, or t
  misc_feature (177)..(177): n is a, c, g, or t
ccacttgcaaaaggggatttctccaagcctttatttgggtacgccaggtttcccagttcccacgtgttaacgcggccagtgaatgtaattcgcctcctaaggccgaatgggtccggggcccccctaaggtcgacggatcaatagcttgatatcaattccgccacaagagacnctggntaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413645 - DNA, 2900 bp, Homo sapiens
actgtgcttattactccctttaataactaattccaagagtttaataagcacagtaaaaaatgaaaaaacaaacaaacaaaaagcaaacccctgtaaattctgtgaggcttaaaagcttgagtttagaatgagcaaaggtttaggtttttaatcctcaataattaaatcagatggtccacaaataaagcttcaccttgaattttccaggatcagaacactaaagtactagtgctaaatttcagcagactaaagagtcatttttgaaaggaatttgacagagtatcagtgtccaaccggtaaatggacaacctagataacagataaaatacaatgaaataagatcccctgaataaatacttgacacttaatatgtaaacaaagcccttacaatgaaggggtttaattctgtaaaatatcagtgttctattcctttccatttgttaaatttacccactgtagaaaatatatactgaatataaagtgacagaaacttatgttggaacatatcaaaacatatgacagaaacatatcaaaacatgcctggcacagtataaattactcaataaatatttgttgcacgaataaacttctagatctaaagctgtagtaagcaaatgtcaactctgtgtcctgaagtagcaaagaaaggaaggcaagctttctgagtaatgatgcataaagctcaatttgataattgttatctagtggtatattcttaatttacagttttaaatttagtattttctgggagaagtaaaaaagatacaaaaccaaaaccatccagatcagatgagagtcaggtgtggagagattttcaatcccattaatttgaacacattatgattgccaaacattaagtatcataagctcatcagtgctatttttaaggctcagtaaaatagaaaactaaacacttttaagttatgctgaccataacagcttatattgtctaaaataactatgcacacaaaaggtactcaagaaatgtcatctgacaatttcaaacaaactttgtgaattgttccttaaaagttcttttctcttatattgttcaaatgttccttaattttatatggccaccttcaccaagtgaaagtgctaaaaataaatgtcaattttaaaacatttgctaggcagatatgctgaaaaagatccaagtgctttaaagtataccactgaatttctaagtgagatacttaataaaaaagagaccaaaataacaaaacttcacattaagcctcttcacattatgtgagataatacataacaaattataatttagcatccctgatcagaataattaagaaaagaggtagaaaacttttatctggaagatcttgtagtgaagctaagttttagagggtgtgccttgcggattagtccactaagcaaatggctacacatctagtactaggaagaagcagaattctgagaaagctgcataaggcaaggatttacaattttttctattttggaagtgaaactagttcattcaacagtattactccaattgctttaaaacttcaaaaatcaaagtaaaagattgcagataagcaaagtgctaatttgcagaaatgtgaaattatttaaaataactttagtggagggataaggctagcacaaaagcaaacactctttaggtgtgcaaaaaatcttacaaaaaccaacccaaagcagagcattattacttgaaaaaaattttttggaggaagtgctcttaacaaaaagctgagaaaattaaatcccccccgataaactttacgcaaatgaagaaaaaactgaggactcgaatttcaaggaatttcaattaaaaaagtaccctgcttaactttaaaatgttatccaatgtgacaaagaccaatacatgaattgcattaaaacacgaggccaacggtcttttaaagcttcaggaagctgctcaggcacctattccctcatacattctacgttttatatgctagagatcttaaacagggcacaatcagttcctgttttgtgataacattctcaaggatgagactcatccctgtaaaaattgcttgtgatgtacttatcagtggttaagcacacatttataatgtctaccaaattgcaatataaaatcagtttggacaattctgagtatcttcatttgatgaatcaattcataatttagaaacttaactcattcagagtttttaaaaagactcagttactggagacactgtggtaaatgtccagtggactcacaggaggccttccacattacccaaaatgtgatgctttcttctacaagttaaagctgctgggtgctagtttataatactcaatctcaatcgtatgcccagtggactcacaggaggcctttccacattacccaaaaatgtgatgctttcttatacaagttaaagctgctgggtggtagtttataatactcaatctcaaccttcaggtcagtgtcagtaggtggcaaggatcacctattctgtcactccagcagaaagaggcatgtatgtacagtttaccactgtagacacacatctgtaaacttgcacactaattttaatcttaacaaggaatttcagtgtcttagtggttttaagttaaaaggatggttcaagcattgtatcctttgttctttagggttaccatagcttattggaaaacccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413646 - DNA, 529 bp, Homo sapiens
ccccatttaaaaaaaaaaaaaaaagaaaaaagaaaaaagaaaggaaaagaaaaaaaaagaaaagaaaaaacattgtttatgaagttcagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctccgtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413647 - DNA, 398 bp, Homo sapiens
aggcacagacaccaaggacagagacgctggctaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413648 - DNA, 679 bp, Homo sapiens
  misc_feature (10)..(10): n is a, c, g, or t
  misc_feature (609)..(609): n is a, c, g, or t
  misc_feature (678)..(678): n is a, c, g, or t
aaaaaaattnggcaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaaaaaaaaaaaaaaaaaataaaaaaaaaaaaaataaaaatttaaaaaactttttattctttttaaatttatattatttttnatcaattttaacttttttaatttaatattactaattcctttttccccaattccacctttatttcccatna

SEQ ID NO: 413649 - DNA, 637 bp, Homo sapiens
aggcacagacaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaacaaaaacagcctccgcccaaccaccctccaaccacccgcgacactccgctgtcccccatccccccccaccccaccaaacgccgtcccaattcccgggctcattcggccaattcccccttatggcgggcggtattcaatttaactgcgcccggggtttac

SEQ ID NO: 413650 - DNA, 650 bp, Homo sapiens
aggcacagacaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaaaaaaaaaaaaaaaaaaaaaaaaaataaaaaaaaaaaaaataaaaattttatataaaaaaaaaagcatgcggccgcaattggagctaacttggcccaatctgccctatgggggggcggataccaattcaattgcccgtcggtttcacaaacgcgggactggg

SEQ ID NO: 413651 - DNA, 644 bp, Homo sapiens
  misc_feature (486)..(486): n is a, c, g, or t
  misc_feature (520)..(520): n is a, c, g, or t
  misc_feature (534)..(534): n is a, c, g, or t
aggcacagacaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaanaaaaaaaaaaaacttgtggcccgcttggcccaancaatttttgacttnggcaaggttattcatgcggcccgaatttggggctaattgggccaattcgccttaagagggagcctattcaccatccaactgccccgcggtttaaaacggtgggaactggg

SEQ ID NO: 413652 - DNA, 686 bp, Homo sapiens
aggcacagacaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccacaaaaaacaatcctcccctcacacctctacactcctactacctcttctctacacctcctaacatattaaaaaaaacaggccgcccgcctttgcccaaccacctttagattgggcaagttaagcatgcgtccgaattcggggtcactggccaaatcccccattacggagtcgattaacaatcctgggccgcttttaaaactgctcaactcga

SEQ ID NO: 413653 - DNA, 645 bp, Homo sapiens
  misc_feature (539)..(539): n is a, c, g, or t
aggcacagacaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaaaaaaaaaaaaaaaaaaaaaaaaaataaaaaaaaaaaaaataaaaatttanataaataatatttaaaatatattatatattaatataatatttttttattaatttttaattaattattttttattatatttttattaaatatatttatttataaaaa

SEQ ID NO: 413654 - DNA, 478 bp, Homo sapiens
  misc_feature (10)..(10): n is a, c, g, or t
aaaaaaattnggcaccaaggacagagacgctggctagggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413655 - DNA, 821 bp, Homo sapiens
  misc_feature (590)..(590): n is a, c, g, or t
  misc_feature (651)..(651): n is a, c, g, or t
  misc_feature (654)..(654): n is a, c, g, or t
  misc_feature (733)..(733): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaaaaaancctttggggggggcccggaacccaattcgccctatagggaggggaataacaataaaatggncgncattttagaggggggccccgggcaaaaccccgcctttgggggactttattgacattgaggggacgccgttttaaacagntggggtggtagaaacgaggggggaaccaatatattttctagagaagacacccttttgggcgaggggttggggccatccccggctttcc

SEQ ID NO: 413656 - DNA, 762 bp, Homo sapiens
  misc_feature (718)..(718): n is a, c, g, or t
  misc_feature (727)..(729): n is a, c, g, or t
  misc_feature (735)..(736): n is a, c, g, or t
  misc_feature (740)..(741): n is a, c, g, or t
  misc_feature (751)..(751): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaagaaaaaaaaaaaaaaaaaaaaaaaaagcatgcgggccgaaattcgggctcactgggccaattccccctaaagggggtcgattcacattactgcgcccgggtttacaacggggggactggaaaaccctgggttncccaataannnccttgnngaanncccttttccnggtggggaaaa

SEQ ID NO: 413657 - DNA, 879 bp, Homo sapiens
  misc_feature (835)..(835): n is a, c, g, or t
  misc_feature (844)..(846): n is a, c, g, or t
  misc_feature (852)..(853): n is a, c, g, or t
  misc_feature (857)..(858): n is a, c, g, or t
  misc_feature (868)..(868): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaaaaaaaaaaaacaaattaagacaaaaatagccaaaaaaatcttaaaattatacaaacgtatatccggtgcggcaaatttaaggttaacttaaaaaaattgcccctcttttgggccatctgacttttaactgtgcgagtttttaacaaggtggccattgttaaacctcatggggcaactcccctttaagggggtgcgttaaaaaccccttggcgccggttttaaaaccgttagtagggaaaaccctgggttncccaataannnccttgnngaanncccttttccnggtggggaaaa

SEQ ID NO: 413658 - DNA, 901 bp, Homo sapiens
  misc_feature (670)..(670): n is a, c, g, or t
  misc_feature (731)..(731): n is a, c, g, or t
  misc_feature (734)..(734): n is a, c, g, or t
  misc_feature (813)..(813): n is a, c, g, or t
tttttttttgcagacagcacgtactattttattgggcctcaaaagctttaaatacagaatgggctggccagagcgaagatgtgaacacactggcatttgagaatggacgtatcagaaaaatcacataatcaacagttggaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaaaaaancctttggggggggcccggaacccaattcgccctatagggaggggaataacaataaaatggncgncattttagaggggggccccgggcaaaaccccgcctttgggggactttattgacattgaggggacgccgttttaaacagntggggtggtagaaacgaggggggaaccaatatattttctagagaagacacccttttgggcgaggggttggggccatccccggctttcc

SEQ ID NO: 413659 - DNA, 734 bp, Homo sapiens
  misc_feature (558)..(558): n is a, c, g, or t
  misc_feature (598)..(598): n is a, c, g, or t
  misc_feature (632)..(632): n is a, c, g, or t
  misc_feature (646)..(646): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccagaaaaaaaaaaaaaaaaaaataatnttattaaaatattatattaaataaatgggaaaaaaaaaanaaaaaaaaaaaacttgtggcccgcttggcccaancaatttttgacttnggcaaggttattcatgcggcccgaatttggggctaattgggccaattcgccttttgggggccttttccaataaatggccggcgtttta

SEQ ID NO: 413660 - DNA, 707 bp, Homo sapiens
  misc_feature (689)..(689): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaaaaaaaaaactcgagaagaaaagtaaaaagagttttgattattcaggcagcatttttaaaaacctgtgaatttgtatcagttctcatctcatttggacacaagtattgactggacctttggactcttctattagtgggaatantcagacatgctgtgcttc

SEQ ID NO: 413661 - DNA, 700 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaacaaccaaacacaaccacacaacacaaccaccccaaaataccacacccaacacaaaagctgcgcacatatcggccctcacttgacacacgcccacatagggccagccccacacaatctccgccgccgctgttaatccatgtcccggacc

SEQ ID NO: 413662 - DNA, 782 bp, Homo sapiens
  misc_feature (572)..(572): n is a, c, g, or t
  misc_feature (594)..(594): n is a, c, g, or t
  misc_feature (619)..(620): n is a, c, g, or t
  misc_feature (673)..(673): n is a, c, g, or t
  misc_feature (697)..(697): n is a, c, g, or t
  misc_feature (732)..(732): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccactcgtgccgaattcggcacgagcacaactacataagttngagaaatatgatgagtcctccnatctgtatgaccatagagacatgtnnttgcagagctatcacatctggaaacagatttggacacacagatactggagatntctaaatgggatcactatataaantactatgtagatctgaaagaagtgaattattaacnttactgatattattaaagggctgatgcttcaggtcatatgaaagactttt

SEQ ID NO: 413663 - DNA, 750 bp, Homo sapiens
  misc_feature (542)..(542): n is a, c, g, or t
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaacttcaagntaagaacctgatgatgttccaatgattcttggtggaataagtgtgacttggaagatgaaagaattgtaaggaaggaacaaggtcaaaatctaccaaggacatggaacaactgtgcattcttaggggcttctggaacatatgcgttggggatgagatcttatatgacctggggcgggataataaccgatgcttcccctgggagggtcgc

SEQ ID NO: 413664 - DNA, 705 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccattttttttttttttttttttttttcatttttaatttaggtttgttttatttaagtttaatgttaattccatgctgtgtttcagtaagaacaatacagattctgtatctgtggctccagtcagatatccagtagtacaaattagcttcaagttacacatactgaacaaaagag

SEQ ID NO: 413665 - DNA, 434 bp, Homo sapiens
ggaattcggccattatggccggaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaatggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413666 - DNA, 827 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggtgggtgtgatatggagagggggccaaaagggagaatgtgctggtggttatagctacctatctgcctgtgctcttatatccaggtctggcaaccaaagggctcaaaaggaagatcattccctctctaaagcccagaaagcccatccaaagatctggctggatacctttttggggagggggcagagagctggggtgggtactggcagaggtatggcaggaggccaggattcactgctgtggacccagctgaaaagaggtgtgtgtgtgtgtgtgtgtgtgtgtgtgtgtgggcaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413667 - DNA, 763 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggtgggtgtgatatggagagggggccaaaagggagaatgtgctggtggttatagctacctatctgcctgtgctcttatatccaggtctggcaaccaaagggctcaaaaggaagatcattccctctctaaagcccagaaagcccatccaaagatctggctggatacctttttggggagggggcagagagctggggtgggtactggcagaggtatggcaggaggccaggattcactgctgtggacccagctgaaaagaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413668 - DNA, 928 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtaagtctcagggcaaggggttcaggggctgtggaactgtggagagaaagaagggaagatgagaggtcccacagaagtctgaacccaggggtggggattagggcagattaggcttaaattgcagagaaaaagtatttcatcacccaaagatcccacacgtctcttagatagagaggaacagcaagaactgggccttgaatttcagtctctagagtctgtccctctacctagcaaaggtcttgactctattcctacctaggggctttgccatgcgatggaccaggcactagagtttggggacctgagtcagtctgctctgacctcccaccaccaccaaggcccctgccagtgcctagggtccctcagattaaactctaatcccctcacctatccaggtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413669 - DNA, 1222 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggtgggtgtgatatggagagggggccaaaagggagaatgtgctggtggttatagctacctatctgcctgtgctcttatatccaggtctggcaaccaaagggctcaaaaggaagatcattccctctctaaagcccagaaagcccatccaaagatctggctggatacctttttggggagggggcagagagctggggtgggtactggcagaggtatggcaggaggccaggattcactgctgtggacccagctgaaaagaggtgtgtgtgtgtgtgtgtgtgtgtgtgtgtgtgggcaggagctttggttcggagacaggcaaaggagccatgtgtggagagcctggtttctcagtacttccagaccgtgactgactatggcaaggacctgatggagaaggtcaagagcccagagcttcaggccgaggccaagtaagtctcagggcaaggggttcaggggctgtggaactgtggagagaaagaagggaagatgagaggtcccacagaagtctgaacccaggggtggggattagggcagattaggcttaaattgcagagaaaaagtatttcatcacccaaagatcccacacgtctcttagatagagaggaacagcaagaactgggccttgaatttcagtctctagagtctgtccctctacctagcaaaggtcttgactctattcctacctaggggctttgccatgcgatggaccaggcactagagtttggggacctgagtcagtctgctctgacctcccaccaccaccaaggcccctgccagtgcctagggtccctcagattaaactctaatcccctcacctatccaggtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcca

SEQ ID NO: 413670 - DNA, 807 bp, Homo sapiens
tttattttgtagcgccaaggtctcactatgctcacacctgtaatcccagctttgagaagaggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtaagtctcagggcaaggggttcaggggctgtggaactgtggagagaaagaagggaagatgagaggtcccacagaagtctgaacccaggggtggggattagggcagattaggcttaaattgcagagaaaaagtatttcatcacccaaagatcccacacgtctcttagatagagaggaacagcaagaactgggccttgaatttcagtctctagagtctgtccctctacctagcaaaggtcttgactctattcctacctaggggctttgccatgcgatggaccaggcactagagtttggggacctgagtcagtctgctctgacctcccaccaccaccaaggcccctgccagtgcctagggtccctcagattaaactctaatcccctcacctatccaggtcttactttgaaaagtcaaaggagcactggcctctagaacacccactggccagtcctagagctcctgtccctacccactctttgctacaataaatgctgaatgaatcca

SEQ ID NO: 413671 - DNA, 777 bp, Homo sapiens
  misc_feature (14)..(14): n is a, c, g, or t
  misc_feature (733)..(733): n is a, c, g, or t
  misc_feature (742)..(744): n is a, c, g, or t
  misc_feature (750)..(751): n is a, c, g, or t
  misc_feature (755)..(756): n is a, c, g, or t
  misc_feature (766)..(766): n is a, c, g, or t
gttgaccaacattntgtcacagcattttcacacccattaccgacgttaactgggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaatggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatccaaaaaaaaaaaaaaacaaaaaaaaaaaaaaaaaaaaaaaaaaaaaaaaaaaaaaaaaaaaaaacaaattaagacaaaaatagccaaaaaaatcttaaaattatacaaacgtatatccggtgcggcaaatttaaggttaacttaaaaaaattgcccctcttttgggccatctgacttttaactgtgcgagtttttaacaaggtggccattgttaaacctcatggggcaactcccctttaagggggtgcgttaaaaaccccttggcgccggttttaaaaccgttagtagggaaaaccctgggttncccaataannnccttgnngaanncccttttccnggtggggaaaa

SEQ ID NO: 413672 - DNA, 396 bp, Homo sapiens
atgaaaaggctttgtaaattctaaagtggtatagtgacacctgttactattgccgttgtcattttcacttagtcatcatgccgcccagctacagcagcccagaggtgatgtgtcacatacctcactgttgtggccctctggccatgaggtctaattacagatggacatggaactgtcctgagatttcgttctttctgtcagaaaataatcataatgctcatttgaatcacagaaatggctacaagtaaactaataaatgagagttgttctcataatagatttaaattatttcttaacgtttccattgtcatctcaaatcattacatgggcattggatacaaatgatgctagcaccctccctagtcagtaatgacaccatcatatttaggacatcaa

SEQ ID NO: 413673 - DNA, 346 bp, Homo sapiens
gtgcccagcctcagacggacccttaaagtcttccagatccaacacgatggaaatagtgctggcccagcagacagagatatgacaagtgtgtagcatctgctgtggctggctctgcttccctgatgcttcactggtaggtttttcttctagattctcaacaactctacctgatgtcatgtggccttagaacttgctcacataattgttcatagcagttagtgatcaacagaatgtgaaccattccaagactgagatccatattcacttagccaagcaaggctgaatagagtcccaggcccttccaatatgcaagccaaaggagcaacagacttagccttgaataaag

SEQ ID NO: 413674 - DNA, 415 bp, Homo sapiens
tttgcccagactggactccaactcctggcctcaagcaatcctcccaccttggcctcccacagtgctgggattataggcattaagtcactgtgcctggcctcccaatttcttttgtgctttttttttttttccccctcataggaattagcttctaacccttggcttgcttctcatccctctccagacttctgtattcttttagagaggggttactaccactggactcattgctctagtaagcaggtgaccacactactgcagattattgaggaaaggtctcttctggacccttgaacatcacctctaatacctgaagttcacactggcttttttttttttttttctagttgtagtcctaaacttcagtgtttgatttttttatgtgcataccaggcttcccagcaggccaggtgat

SEQ ID NO: 413675 - DNA, 314 bp, Homo sapiens
ggtgggaagactaaggctcagagaagctcagcaacatgcccaaggccacacagtgtttgaagccaggctccagatatgcatctggcactggcgcgaccatcttctattctgcagagtacctggtttctgttttgtaagatgtgactccccctacccactcacccacccagatctgcagagggtgataccacaacatgacaaatcccagtgaagggacagtgagccggacagggacagagatcaaaaggaggttcctctggctccatggctctgtggagaagcccggcagccaccaggttccctgcaaggcatgg

SEQ ID NO: 413676 - DNA, 1525 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413677 - DNA, 596 bp, Homo sapiens
  misc_feature (53)..(53): n is a, c, g, or t
gtggttgtttagtatttggtttttatttttttttaaaacgaaaacgcggctcngtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413678 - DNA, 1018 bp, Homo sapiens
gtctctggttgccttgcaaagttgtcttgtgttgtcaagactcaaaaagaacatgccacgtgttagcagaaaggtacagatgtaaacaaaagcttcataaatgttatttaaattgatttaccatcttacaaaattaaattttgtttcataaattaaagctttgcttagggaagtttaaaaaaataacatagttatcttttacttttatatgtacaagtatctctgctgatgtttcatcagaaattttatgattcatgatttgtgtatactctttttggttgttcaatatgatgaaattgtaaattaacaaaagaccaagtgattaaattatacggttagagaaaaaatatttttaggacattcaaatgacccacttcacgcatttgtttcagtccattcccttgtatttcccctacattaccattttaaatgctgatttaactgctgttctagccagcaatgaaaggaatgtctatgtaaatttaaaccacaaattaaagctttcagcatcttctctcaccctgaccctgttcccaacctaagcctcatctggttaaaggcactagtttagaaaaattgccctgatgtaaaaattacaattagttgaatacaattatgcacgagttcaactaattgtaatttttacatcagggcaatttagaatggaataacaaacatattgtattttccttatgttctatgttcagcacataataattttctttctttttcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413679 - DNA, 515 bp, Homo sapiens
gacttataaaggtccaaggatttagagatgattaagagataagctggcattctgtaaaggcaccatcgtctatcccctgtcttatctagataaagaatgtagtgctaaatcttgtaataatattgtacaaatggaaattcaatcttaaggattattttttccatattgttgtatttcattgtggtgtattggaaagtgatctggactttgagtgagaagatgtgatttggaccatggcacttaaaaactctataacctcagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttaattctatctaggaaaaatgtagccaaatcttttttcccattaacaaataatgtaagccttaatattcaagggtaataaaaaatacaagtcttccaaacagtta

SEQ ID NO: 413680 - DNA, 3692 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413681 - DNA, 2310 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctca

SEQ ID NO: 413682 - DNA, 3757 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413683 - DNA, 1769 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgtta

SEQ ID NO: 413684 - DNA, 1590 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413685 - DNA, 1815 bp, Homo sapiens
  misc_feature (1771)..(1771): n is a, c, g, or t
  misc_feature (1784)..(1784): n is a, c, g, or t
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaaaaaaaaaaaaaaaaaaaagctgggttctggctgaatgaaggtggtcagagcgttactggaaaattgatagaccacatggtacaaggccatgctgcttttccagaactacaagtaaaggccacagcacgatgccagagtatatatgcatatttgaacagtcacctggatcctgattaagaanggctcagcctgtngggtttccttactgttggatttacatgtttt

SEQ ID NO: 413686 - DNA, 3855 bp, Homo sapiens
gcggatctcttcgtctttgcagcgtagcccgagtcggtcagcgccggaggtgagcggtgcaggaggctacgccatcagtccccaccaagggccagtcgcccggctagtgcggaatcccggcgcgccggcggccccgggcacgcaggcagggcggcgcaggatccaggcgtctgggatgcagtggagctcagaatgagggggtagggctggggcgggaaaggagccggcggaccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413687 - DNA, 1560 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttaattctatctaggaaaaatgtagccaaatcttttttcccattaacaaataatgtaagccttaatattcaagggtaataaaaaatacaagtcttccaaacagtta

SEQ ID NO: 413688 - DNA, 1495 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttaattctatctaggaaaaatgtagccaaatcttttttcccattaacaaataatgtaagccttaatattcaagggtaataaaaaatacaagtcttccaaacagtta

SEQ ID NO: 413689 - DNA, 3628 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413690 - DNA, 3462 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413691 - DNA, 3467 bp, Homo sapiens
cggacgcgtgggtcgacccacgcgtctggctgtgtgaagatctgcctccttcctcttcggcttcatgcatgatcgtaagtttcctgaggcctcctcagccatgcttcctgcatagcctgcagaaataatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413692 - DNA, 1474 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgtta

SEQ ID NO: 413693 - DNA, 1588 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagggagaagtcctcagataaaaatgtctaccaaaagactgacacgtggagttaatcatttgacagatgcaatgcttccacccccaacaaatatactttcttaacttctgtttgttatcacttagggaaaaaaggcagtcaacaaatatatttaattctatctaggaaaaatgtagccaaatcttttttcccattaacaaataatgtaagccttaatattcaagggtaataaaaaatacaagtcttccaaacagtta

SEQ ID NO: 413694 - DNA, 1436 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgggtcttctcctgtggcccaggctggagttcagtggcgtgatcacagcctacttttaacttcaaaatcctaggctcaagccatcctcccacctcagcctccttagtagctgggactacaggtgcatgccactgcacccaactaatttttaaaattttttgtagagacagggtcttgctatgtcatctaggctggtcttggactcctagcctcaagtgatactccagcactggcctgccaaagtaccaggattacagaggtgagccaaccatgtgcagccatcttcagcctattttaaatgaacaattttttaaaaatacactgtaaatataactagcaatcatttaactgtaacaactattcagtgaattgtaatgtatattttattactggtaattaattcattaataaaggcattctcatttta

SEQ ID NO: 413695 - DNA, 948 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataactcgcctccttgagacacaatgaagaaactgagaaatctacttcgacattgtgaa

SEQ ID NO: 413696 - DNA, 3447 bp, Homo sapiens
cggacgcgtgggtcgacccacgcgtctggctgtgtgaagatctgcctccttcctcttcggcttcatgcatgatcgtaagtttcctgaggcctcctcagccatgcttcctgcatagcctgcagaaatgctggagtgcaatggcgcaaacttggctcactgcaacctctgcctcctgggttcaagcaatccccctgcctcagcctcccgagtagctgggattacagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413697 - DNA, 3185 bp, Homo sapiens
gtctctggttgccttgcaaagttgtcttgtgttgtcaagactcaaaaagaacatgccacgtgttagcagaaaggtacagatgtaaacaaaagcttcataaatgttatttaaattgatttaccatcttacaaaattaaattttgtttcataaattaaagctttgcttagggaagtttaaaaaaataacatagttatcttttacttttatatgtacaagtatctctgctgatgtttcatcagaaattttatgattcatgatttgtgtatactctttttggttgttcaatatgatgaaattgtaaattaacaaaagaccaagtgattaaattatacggttagagaaaaaatatttttaggacattcaaatgacccacttcacgcatttgtttcagtccattcccttgtatttcccctacattaccattttaaatgctgatttaactgctgttctagccagcaatgaaaggaatgtctatgtaaatttaaaccacaaattaaagctttcagcatcttctctcaccctgaccctgttcccaacctaagcctcatctggttaaaggcactagtttagaaaaattgccctgatgtaaaaattacaattagttgaatacaattatgcacgagttcaactaattgtaatttttacatcagggcaatttagaatggaataacaaacatattgtattttccttatgttctatgttcagcacataataattttctttctttttcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413698 - DNA, 840 bp, Homo sapiens
atttctttcagtaaacttatgaaaacaattatgaaataagtattaactatatattgtgtttgagacttgattttcagtttatatacttactaaatccttaagttataattttaggttcaaagtataaactcaacttcaacctcaggaatgcttttcccattatatgagactgcctcaaacctcatttatggttcagaaatgtctttattatgttaccgaggtaatctctacagcacctaaattgtttatactattacatctcagaatatttgctattaggtaattagagtatctgacaatattagatatttaggatattttttctgtgccattctctcattactaggtgaaaatgaaatgttttttacatatttgactttgatacatcttcattatgctcttttattgcttataaatagaaatcattatttttctccagtttgcttatcaataagttaacatatgaagttctgaaagcatggaccattctctttttttcattttttttttttgagacagggtcttctcctgtggcccaggctggagttcagtggcgtgatcacagcctacttttaacttcaaaatcctaggctcaagccatcctcccacctcagcctccttagtagctgggactacaggtgcatgccactgcacccaactaatttttaaaattttttgtagagacagggtcttgctatgtcatctaggctggtcttggactcctagcctcaagtgatactccagcactggcctgccaaagtaccaggattacagaggtgagccaaccatgtgcagccatcttcagcctattttaaatgaacaattttttaaaaatacact

SEQ ID NO: 413699 - DNA, 322 bp, Homo sapiens
gatatcattaggaaaaagaaaataaaacattttatgcatttatatgaaattcaaacaaaaggactttgactctttgtaaatgttaatttctgtgtttaattgcagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggtaatttatgtaattaaaaaatattaaaaactattattcttggttta

SEQ ID NO: 413700 - DNA, 1753 bp, Homo sapiens
gcggatctcttcgtctttgcagcgtagcccgagtcggtcagcgccggaggtgagcggtgcaggaggctacgccatcagtccccaccaagggccagtcgcccggctagtgcggaatcccggcgcgccggcggccccgggcacgcaggcagggcggcgcaggatccaggcgtctgggatgcagtggagctcagaatgagggggtagggctggggcgggaaaggagccggcggaccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagtgatctggactttgagtgagaagatgtgatttggaccatggcacttaaaaactctataacctcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413701 - DNA, 1704 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgtta

SEQ ID NO: 413702 - DNA, 1750 bp, Homo sapiens
  misc_feature (1706)..(1706): n is a, c, g, or t
  misc_feature (1719)..(1719): n is a, c, g, or t
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaaaaaaaaaaaaaaaaaaaagctgggttctggctgaatgaaggtggtcagagcgttactggaaaattgatagaccacatggtacaaggccatgctgcttttccagaactacaagtaaaggccacagcacgatgccagagtatatatgcatatttgaacagtcacctggatcctgattaagaanggctcagcctgtngggtttccttactgttggatttacatgtttt

SEQ ID NO: 413703 - DNA, 3649 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggattttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413704 - DNA, 3601 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413705 - DNA, 3672 bp, Homo sapiens
gctaggtatgaggctgcggttatattggccgaggctgcgtctcggactgaggggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413706 - DNA, 1623 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttataggtaatatctttatactaacatgaatgtttttatttttaactaatagaacagagtttcagtggttaatatataattaaggatgaatgtaaagttgctgtgtggtttttttaaattcagttaagcaagtttttgagcacctgccatgtgttcagcatagtgaagtacacaaaggagatataaggcatggttcttgttccctgacagcatatagtttctttctagacatacatatttttatataacaaatgaggtttaagctcattttgaggacttgaaaatttttatcttcccttagtttgtcgtgatttcgacttcatttgcaagattgttttctcatataattcactgttcattgtctaataaactttgtattatcttttga

SEQ ID NO: 413707 - DNA, 1434 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413708 - DNA, 3629 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgtttaaccattctggaacattgtgttcagagccagaaaaattaatagattttattcacatctatgtctacggcttccttgacaactactgcagatgccgctatcaccatggggatggttcttctaaatgaagcagcaacttcgaaaggcgatgttggaaaaagacggactttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413709 - DNA, 3392 bp, Homo sapiens
caaggccaacaccccagtcgtctacccatagacaaaaaaaaccaaacctctaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413710 - DNA, 1295 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaa

SEQ ID NO: 413711 - DNA, 1006 bp, Homo sapiens
agcgggcctttccaggtcttctcccggtgaaccggatgctctgtcagtctcctcctctgcgtcctcggccgcggcccgggtccctcgcaaagccgctgccatcccggagggcccagccagcgggctcccggaggctggccgggcaggcgtggtgcgcggtaggagctgggcgcgcacggctaccgcgcgtggaggagacactgccctgccgcgatgggggcccggggcgctccttcacgccgtaggcaagcggggcggcggctgcggtacctgcccaccgggagctttcccttccttctcctgctgctgctgctctgcatccagctcgggggaggacagaagaaaaaggagaatcttttagctgaaaaagtagagcagctgatggaatggagttccagacgctcaatcttccgaatgaatggtgataaattccgaaaatttataaaggcaccacctcgaaactattccatgattgttatgttcactgctcttcagcctcagcggcagtgttctgtgtgcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacacgctcggtgccccatgggcacgccggctatacgactcgatatgattctccggacctgaatttaggtaaccagcgcgtagtcgcagtagggactgatccgatcccacacata

SEQ ID NO: 413712 - DNA, 3191 bp, Homo sapiens
tggcccattattcttatcaggcaagctaatgaagaatatcaaatactggcgaactcctggcgctattcatctgctttttgtaacaagctcttcttcagtatggtggactatgatgaggggacagacgtttttcagcagctcaacatgaactctgctcctacattcatgcattttcctccaaaaggcagacctaagagagctgatacttttgacctccaaagaattggatttgcagctgagcaactagcaaagtggattgctgacagaacggatgttcatattcgggttttcagaccacccaactactctggtaccattgctttggccctgttagtgtcgcttgttggaggtttgctttatttgagaaggaacaacttggagttcatctataacaagactggttgggccatggtgtctctgtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413713 - DNA, 2792 bp, Homo sapiens
acactgcaccctgtttttcagtgtatagtctttgctatgacttctggccagatgtggaaccatatccgtggacctccatatgctcataagaacccacacaatggacaagtgagctacattcatgggagcagccaggctcagtttgtggcagaatcacacattattctggtactgaatgccgctatcaccatggggatggttcttctaaatgaagcagcaacttcgaaaggcgatgttggaaaaagacggataatttgcctagtgggattgggcctggtggtcttcttcttcagttttctactttcaatatttcgttccaagtaccacggctatccttatagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacttaacccactatatccattttgctcatgtgttttatgcaaccagctttccatcaaatcctcaatccttgaatccaggtaaaaggttaattatcctaggattagtgaatgattcaatgaagctttcttgaaaacaaacataggagtgtaatgtactattatgtttgtatcctgttttagtttataaagcactttcacatacattatggtatttcttcctcacaataaccttgtaaattagtcaggaaatgtaaattttatctgactcatagaactaatggaagctgaaagccaaaaataaagtttataaccaggccttcaaactctcaaacatggatttttatattctgtggagttatccaaattaattagggtttaggaaagcagttcttcttgagtcagttcaataagtgtttgctttttgtttttaaggtttgttatctaattttcattaagatttgagtaacagaccatggagaattgttttcattgggagttccagctatatagcctcaaacaagaaacgggtgtacaaccattgagtttacttacttaaatctgtgaatttcaatgaagaatgggaatataaaggcctactggggcatgtttatcaagttatatcccagggcaatgtgtatgctagcaggatgaatgctatcttttcaaaacataatattcagtgaaaattacgtaataattgtaagtttataatcatactcccaaatctgttactaaaaataacataaattctcctagttcatgtacttagatgaataaatttagttttggaatgacgtttatggaaaagcaatagatgaacttaatcatttgatcactgcctatcactaggcagaacttgacctgtaattcttaatccattgtagattttttacattttactcaaaacttcatacatagagactctcaggtcaaattttacaagtattaaacatttgttaattataatcacttttgtttgtatccttaaatctcagaattatcttgcagttaatatgcagctgattaaatgatattacaaattatctctaatctcactgtaaatcttttaatcatatcaaagtcaggtcatcctcagacactataactaagatagataaggagtactttactataccatattagtaaaggttttctagctcttattttctaatttcctctgagcatttaaaattacatccagtgataaaaacaatatttttttttcagaatttcatgctttaaaaagctgtggcttctctatagacaactgttacattagggaagtgattctagagcaaaatatactgcctcaacataagtcgttactgactggaaaatgctataggcagaattgcaaagagtggctcaaacatatagtttgcttgcagaatgtaacgtgcaaaatcacatacatgcgatgtatttacctttgctagacaatgagaattgaataattgatttgtacctggtatgttatatcctccagtgtcactttttaaccagattcactgtgcgttccaaactgtcataaaaattgattatatgtttaacaattgtttttctactacagtggagagaaaaatcccaattataaaattccacctaaaggagtttcattttgtaataacatctgattaataacttgttgcattttgcttaacatactgttcctggcattagatattcacatgagtaagcccagtagcaaaat

SEQ ID NO: 413714 - DNA, 272 bp, Homo sapiens
gaaatggattcctggtgcatgggatcgtggctgccggcagatggtgttgctgatttctttcctcacggacttgctcggaagtgctggctcctgttggctgggctcccgaaacgcctggttgtcagtgtcagagcagcttcggccgtggccctgacatgaaagaggggcgctggtgtcgacctcctggcccccatggggttctaaccaccacgcagtgttctgggtttaagtatattcagattgtggattgaaatacacaagcattgatcaac

SEQ ID NO: 413715 - DNA, 456 bp, Homo sapiens
gttaggcttttgttaaacccaagtcagttaagctgtagtagaagttttctttgaaggcaggctgttagggagaacagagagctctgggcatatttcagaatggttaccttctcatgcttctgctggaaacataaaggtatttttctccagtcttcacagtgagaatctggtggaattcctggaggtaaaactcaacaaaagtgtaagtgtgagggttcccccctgccctgaacccttggagttttgaacactgaagctagtctacactgagcctccagcagtttttcagttaagtcttcctacctgtattggctccatctttgatcttctgctcttgggcttctgcttcttgttaagctgtgactctgtttccacctgtctgtctctccagtttgcaaagtagcagtttgtcctgtgaccttagttctctgaaagatctaagaaaagttgttgatt

SEQ ID NO: 413716 - DNA, 375 bp, Homo sapiens
tcatagaccctctttttctgtatcccaatcagactccctttccatatatagcacccctgtcccacttgtttaagtaggaatctcctttttggctctaatttcactgaatattggtacttttgtatccccagatccttcaacaaccttccctctacctgtacatgccaactcattaccacctaccaaactagattttatttcagacactatgtatttaaagcttgagtataaatggcacagtgagtggtaatgatgtagtatctgaaattctagccctgaggtaaaacacttcagtgacaggaaaatagtaaaaaaaatgcataagtactgttgcagatgttgtacttccatattgaaataaatatttatgtttag

SEQ ID NO: 413717 - DNA, 374 bp, Homo sapiens
ggtgggcatcctgtggtggaaatcacagtttgcccgagccaagcagagagctgagctgacagcctgtgctcttccgcctgcatggtgctggagaggagcgcagagcccactcatttgcaaggacagggctgtgtctcgcagccatcaacttagggttctacccttcaagggtccaggcagggacaggcttgagcagctgtggaatgcaaagtgctgaccctcttgctccagggtgcaggtgttggagtgagctctctgctgcatcaggaacccctgcagtgagtgttgtccactcactgggatgcccctccatcctctggacaaaggcaattgtgaggctctgcgcacttggaggccaccctaacacactcttt

SEQ ID NO: 413718 - DNA, 413 bp, Homo sapiens
ataccttttagctggcataatttaacgttctaattatcccttaatcataagctgtacgattctataattaaaaagttaatgccttcttaatgtctattctagtagaagaatgatgagaaaataatagtatagattagttttggtctctactcattttgccttctgattatattacaactccagctggtgacaagatggctgtgtaaatcttgaaatcactgagcattcattttagcttctcattgaaaggtagatattcagtatgaattgtaaactggcattaagggagaaagtaggaataatcaaacttgatctgagaattacttgctggtgcattttctcaatgcatagtaatatctttatgaagatgcagaatgcaaaagtggttttggaggtggataaggagggcagct

SEQ ID NO: 413719 - DNA, 651 bp, Homo sapiens
caagaactggtcagacctgggtaacaaacatacatgtgtgtgtctgtgtgtatacagcaatgcacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggtttaacaacaaaaccacacacacaaaaaaaaca

SEQ ID NO: 413720 - DNA, 6821 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413721 - DNA, 4411 bp, Homo sapiens
tcatagcctcgccagtgtctagcctcgccagtgtcctagcctcgccagtgtcctagcctcgccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413722 - DNA, 6767 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaactgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413723 - DNA, 3264 bp, Homo sapiens
gaatggcgagaaaggggagctggaagagccttggaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413724 - DNA, 4453 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413725 - DNA, 3131 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaaggtgagtagcacatttgtagccaatatctgagccgaagtgtaagcatatttcccgaaataaaattctgctttgtttctttaggtttttctgactcatagttagagaagagatcaatgaaaatgcctggtctaacttccttgctcttttgtaaataacaaatggaacccagagacatcaggtggcttagtggcatcttattaaaatgcaacttcaaaaaaagctagattaaaggtctggtttttgggggtaggggagaagcttagacattttaatttatacacaagttgaaatctgaggtaagagcatttgttgaaaccaaatacctacatttactgctacagttattaagtatgaatagaaaaatagaggcattttaaatgaagcagccaaatgaaaaatagctttagaaactgaaattaagcaatatttttattatctcttctcaaagaaataagctcaccttaatagtaatcag

SEQ ID NO: 413726 - DNA, 3929 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggtt

SEQ ID NO: 413727 - DNA, 4757 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtattttaaccacagtgtcctaaactgagaaaactagagaggaaaaagtgggtgttcatgaactttgtagttgggagagtggttttacatgtctgtgtattcatgactttgggagtgggtaggatcattggagagagaattgcacagaaagtcctgaagtttaaaacacttttgaccagctttggctcgggagagtggggctgcttgtagaactggaagtgaataactttttcaagcaatatcagtgagtgggtcccatcgacagggttccaggacctggaacactttaacagaaggaaatgccgaagcagcttgcacagttgctttacagacttccaagaggctgattctggcttcaagatggagccttggagttggtttttttttttttttttcttccctcaaagaacctgcggttgcgctttgtgtgttttgtttttgttttccatttgggggccccatgggaaagagcttctgaactctttcctttatgaactcccactgtgttcctataaaggcccttttctttcttagtgttgtaagttacattttcattatgccccatcacatcttctttactgtaaaaatattaaaaagctgtttccaagtgggacagctaatgaagctctaattattgcagacatatttttgagatgtaaaaaaaaaaatttaaagttaaatgataagtcttagaggcgagtgaggaataaaatggatgtaaacatttacatgggatgcattagaattctgctgtgtgtactgtcttttggttgaaacaaattatgaacagtgactaataataaaaagtcaatacccaatgatttaaaatttgctt

SEQ ID NO: 413728 - DNA, 6457 bp, Homo sapiens
agcggattcgaggtttcgggccggtgagtgtcactcccggcgctgagagcatattgctgcttttgccccgccgctgccgcgggcgctcgaccggaagcttcctttcagtttcaggggtccagtcccaggctgtgggtgttgagaagagaagacagagaagctgggccaggagaggccgggagccccagggctgctccgacttctggagggccgaccccgaggcctcggaccgggaggttccgcgcgccgcggcggtttcattcgaggtttcgggccgaggatgccagcccccatcagattgcgggagctgatccggaccatccggacagcccgaacccaagctgaagaacgagaaatgatccagaaagaatgtgctgcaatccggtcatcttttagagaagaagacaatacataccgatgtcggaatgtggcaaaattactgtatatgcacatgctgggctaccctgctcactttggacagttggagtgcctcaagcttattgcctctcaaaaatttacagacaaacgcattggctatttaggggcaatgctgctgttagatgaaagacaagatgtccatcttctcatgaccaactgtatcaagaatgatcttaatcatagcacgcaattcgtacaggggttagcactttgtaccctcggctgcatgggctcctcagagatgtgcagagatcttgcaggagaggtagagaagctcctgaaaacctccaactcttacttaagaaaaaaggcagcactgtgtgctgttcatgtcatcaggaaagttcctgaacttatggagatgtttttaccagcaacaaaaaatttattgaatgagaagaaccatggtgtcctccacacatctgtagtcctcctcacagaaatgtgtgagcgaagcccagacatgcttgcgcatttcagaaagaatgaaaagcttgtgccccaattagttcgtattttaaagaacctcatcatgtccggatattcaccagaacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattagatatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcagagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacaggtgctccagctgctgctcctgcccctgcctcagtcccacagatatcccagccccccttcttgttggatgggctttcatcacagcctctcttcaatgatattgctgcaggcatcccctccatcacagcatacagtaagaatggcttgaagatagaattcacctttgaacggtcaaataccaaccccagtgtaacagtgataacgatacaggcctccaacagcacagagctagatatgacggactttgttttccaagctgcagtaccaaagacattccagctgcagctcttgtctcctagcagcagcattgtcccagcatttaacacggggaccatcacacaagtcattaaagttctgaaccctcagaagcaacagctgcgaatgcggatcaagcttacatataatcacaagggctcagcaatgcaagatctagcagaggtgaacaactttccccctcagtcctggcaatgagggtttggcaccattctcattctttatcccactcaatcaaaggaactctgggaaggaggttgtgattgctggcaagtcccccccaactgtaccacgggcatgaggagctgaagagaactgctgaggaggattttcctaaagttactgctgaccttgaagcattgttaaagactaatgtcctctcctccactgttgaggctggctgcttctggaggctactttgcactcttcctcttctcctttttccgcacttctccacccctcccacatttacagccagaatcaacattccctgggcccctgaggaaataagcagctggtctggaggagaggactgcaatccatggcgaaaaaacactcactttgtctctgcagcaaagagttgccccttctttctactgttgtttctctgtggactgggcaaggtggggtatttattcctcactagctgggttaccatcttcaggcacttttaacatctggcattcggaatggaaatgtaataatggacattagggagccctgcctttttctactggttcccccaatgtttgaaagaggcattaggctcctggtagccttttctgtgcattgctgtatacacacagacacacacatgtatgtttgttaccaagaactggtcagaccttgcgagtttatttgtaaacactggacagatggagttaaaaagagcttttgttgagatttggcatgaaggatatggtgctctatttgtaatagaaacttccaaggctcttccagctcccctttctcgccattctttagctgtagtcatgaatagtctccatgattttcaaaattgattccctttaaagtgcaaaatggtcaccttctaaaagatatattcatagttattaatgaccctattcccaccacaaattttaaagtgctcctaagcccataacttgcctgtttgaactatggtaatgggtggaagaggagttcaccagtttcaaagatcagactctgtatcaaaagtacctttgcccttaggaagagtgagtattggagtcatcttatctattactccaaacctccctttttatttcttgagcctggcttggaccttggcattccgtttgaattccttctaactggaacatttgtgttgtatctgtaacactggcactgaaataaagaccacacggttaaagaaatctttccatattgtactttatggtgttggagtgaagccttgtagcttccatacccctatgtcagaggaggtcttacggacaccatagggtaggaatagcctttcctcagtctgagaaattggtctcttttaaaagacgaatctcatgaatattcacatcaaagacttgagctttttaaactagtgagagtgccaagtgctttttagaaaggacccatatgttatcaaactttgaaattgagttgctggaatgaagtagaggtgactctctctgtggtacacattgaatgtactatgtatgttcaagtattcaggcgccatgtcttatatactgaagaaagaaaaagtgaggcccaccttgctcttacaatgtttgcaattgttactgtattgaatacagtataatgactactatggcttcaatcttaaacctggaaacaaatatccctttttttccccttcatttcaccaagcctttacttaaaatcttcagtgtcttgtcaaatctagctctgtatcagatgctggaatattcctaacatttgacaaactggagttgaactaaaggctccacgggaaagtttctggtcttactagtgtgtatgagcaagatctgctaaaacttactccactgggtaaatggttgactgagtcaagaacaggataatatctcctgcatagttttcagtaatgtaagtgtggactagtgcatatttcagacaactgctctgcctgtgcaatgaaaaatagcctttaagggtttctttgcagactgatttcattggatggatacttaatgctgtgaaacatgataggattaacataatgttggtggatttcttgaatagaatttgtcttaacattcctctttgtgtagaggctttattttctctcttatatttgtagctaaccagctcaggtttttttatttgaactgggttgaatctctgaagaaatctgttcaagaccatgctataagacactgtcagctaatggagctgggaagggtctactctgctgacagagcatttccttgggtgatcatagtttcgaggtagagtttatgatcattcatagctttgtctagaaggagtaaaatatcatggccttaacacaaagggtgctgcgtagaatatgaattgattttggaatcagaacacaagcaccatactgaaggactagcagccaaataactgcctaggatactgatggttgtgaagactgtttcaaatgattggatctttgaaagcttcagcgtgccttagtttctaggatcagaattagttttcctctcacttggccttgcagctaaatggagaaatgtttcaatttctttgaatacttgcacatttcaataattcctttcccgagtataaccactcaagggggagcaaatttggatggatttacgacttcacaggcattgtgaggaaagagcattttccaaggctgttttgataaccctggggtgataagcagtgagccctcacacacttactttgacaatttcacatgcacttgtacttcattatttccctcttcaagagtcgtttctattctagtttctgccccatcccggggaatcctaaaggagaattaattcatctaagtaatctcaaaaaactgtaggaagggtgctctccctgagaagcttctcccacagtgctttggtgctgttaccttgaggtggtttggacagtcacggaagttttaggctgtgcatagtgatcatctgttaattttaaggtctttatcatttaaagaaacattcctcagtgtaacatttgggaggggattctttcctcttgctagtttaaaggtgtgatttgtactccttgtttgtcccattcatatatgaaaatagacttttaaaactgtccaacactaatggtttatataacatgcttcccattttttttatgtcgtagaaattggaagttagggagtactgctttcaaggttcaacttcattatcttctgcattggaaaatatttgggccatgagaactaggggaaaggagtttgaatgtgtctatttttttctagtgaatgtaggtttaccacgatgatctgaggagattgaagctactaagaatcatgttctagagaccttctaccccatatcacccatcagcgatcttcatgaatgcaatatttatgatgtgaaaaatgacacaggattccaggaaggctatccttacccctatccccataccctgtacttactggacaaagccaatttacgaccactaccgccttcaaccagatcagctgcgggccaagatgaccctgtttgcttttggcagtgccctggctcaggcccggctcctctatgggaatgatgccaaggtcttggagctagcccgcggtggtgcagagcgtgggcacggatggacgtgtcttcctatttcctagtgtttcaactgaataccacagacctggactctatacgtagggtgtctagaatttggcctgggtggatctcagatcagctcctctatcagcatttattcgtgtttccc

SEQ ID NO: 413729 - DNA, 401 bp, Homo sapiens
gactaaggtgggaggatcacctgaacctgggaggtggaggttgcagtgagccaagatgatgccactgcatcatcttaggcgacagagtgtgactccatctcacaaaaaaaaaaaaaaatcaaagtgtaaaaatacaggaggattaactaaaaatctatttgagaagcagtgagagccccttccccactccctgcagtaggaggagtgcgctcttccaccctagaaggtttctgctgtgaaaaggctaaacctgggaggctctggcctcagtgacacctggcacagccctgtagagaacctttggaaaaccaggtcacgaagtagcagctttcgcaggaaagtgtaacagtccatgtcttccccgtccagctctgaaaaggctggcagccaggcttatcatg

SEQ ID NO: 413730 - DNA, 385 bp, Homo sapiens
ataactttaacagaggattggaataatgagggattggcaaggaagcagtaaaagggaacactgaagtatagaataatagcaaacagaaggagcaccctacccctagggctgagaaagagcgcagggaagtccttttttcttcctggacagagatccagacgagctggagaaagaagttgctatggtactgcatcagtggaacttgctggaaatccaccctcaagggcactaggaaaacctgttcaggggagctgtggagggaaatggggttggcaggaaagctgctgggcgcggggtgcttcagactgcagtgtattgcaggagctgggcactggggaagctgtgtgcactgcaggatcctgctgagccagcacatcagatcagg

SEQ ID NO: 413731 - DNA, 168 bp, Homo sapiens
cagccttccaggctgcagctaaccagctcagggctataaaggccaggccaccagtggccaccagggggcttccatccctcctcttcagccctgttagagttcagccacccctttaagtcaaactttgagcaaatatttaatgagtgtggattattggtgattttccaa

SEQ ID NO: 413732 - DNA, 1376 bp, Homo sapiens
tgaaccctctccatgttagggagaatttcatacttaaagagtatgatttcatacttaaagaatttcatacttaaagagtcattgtaggaagcagacaccaacttcttccacgaaagaaaaactcacttttccaaatattctggcagctggatatgggatgaggcttaggttccaccaggcagataaccacttgctggattctgactcagcctggtgacataagctggtactgtgcacacattttagtaagtgtggtgtgagttgcagcagcaatgtccagttgccaggagcagtcgtgatagcagttctatctgcaaggtccagtgtctagctttagagtgtcattggtatgaacagtgacatctgtgcccagcatcaggggcagtgattcctatgtgagactccacctaggatgggattatagatgctgcttctagctatgtagctttaagcctattctcacagaccttcccaaaataaaataaacaccagcctaatgaagatagatgatagatagatagacagatagaagtcctttatgtttaaattagaaaaaatagcatttaaatgtggacttaagaccctttcccaccctaggcactgttgatcactgacctcagtggttcccaatctggctgatcaccaggattccttgtagattttttacaaaaatactcaggcctttccccatacccaccatctcagaagtggaacatggatcccaggaataacaagccacaggtgaggctgatgcacagccacctgggaatcctggtctacattcttgctactaaaagcgtgatctgaagaccatcagtgtctgcctcaacttttttataaacacagaatctcattctcaactccagaccacctgaatcttagaaagttgtccaggtgattcctacgcacactaaaatttgagattctcagatttacttactttctagatgtggtgttagaactgtgcagtctgctgtcagagtgtgttctgatgaaatcccttagcactgaaggtccagggttcagtccatgtcctttttctcttctatagccatctttcccttggcgactcatgcatgctctatgctttaaatatcattaatatggcattaactcctaaatctattttcccagcccagacatttctcctgcatttccaacttgcatatccatctgccaacacaacaacctcacttgaatgtctgacatctgagattcaacatttcctaaattgaatgcctatagtgccccctcctcaaatatgcccctttcagaattttccccatctgtgctgacaacaacttcatttttctacttgcacagtctgaaattttggggttcctctttgactcctctttttcataccccagacttaa

SEQ ID NO: 413733 - DNA, 445 bp, Homo sapiens
ggcttatcaactagtgttagactattttatgtgtggcccaagacagttcttcttcttccagtgtggcccagggaagccaaaagattggacacccgtggtctatgtatatgtatgtacacacacacatacacacacacacagaggcacacgttggttctgtttctccagagaaccctgactaatacaggggaccctgggtcacagcagtggtgccttccctcccactgctgccactgggtctgggtgtctgaggcccccactagacataactctgagggcagcagctcagggccttggcacatgttaggtgctctgcagaatcaacagaagaggactttgacaaaaggtcaatgaacctacaaggtcaaatctcaccaaagtccaaggagagaggatggggggtgggccctgcgtgcagcaggctcgtgggttacagcagtggtgg

SEQ ID NO: 413734 - DNA, 5403 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413735 - DNA, 273 bp, Homo sapiens
aaaaaaaaaaaatcccccatttccccctccccttttgaaaaaaccagaagcaaggggcctttccccttttcaaagggtggcaaagaaagccccttggatcaccccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413736 - DNA, 2996 bp, Homo sapiens
gccactcattgctctctcctcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413737 - DNA, 5082 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413738 - DNA, 6125 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtggaaaaaaaaaaaaaaaaaaaaacaaaaaaaaaaaaagggggcgccgcccaaaaagttccccccgagaggggcgcccaaggtgttataccgcgttcccccaggttttcctgtgggtcccaacggtggcgccccataatagggagagcgctcggtattatttaacgcgcatagggcatttggcgccggcgctgtttacacaaccgtctgggtaagaccgtggggagaacaccttggcaccgcctggggggcctcttcggaaaagaggggagccccttttaactctccctgtggggggcggggggcagccaatattctgggggcgccacaacctcaccccataacagaagagattttaaaacggcctctacaagggggggacaatttttataaagcttttttaaaaacgcggttgtcataaccggggtgtgttaccacacataccgcgcgggcaatattgcgacttgggcagcctttggaacagagcttttgtgggccagaatcgcggggagtatattgaactttgtggaacaaacattttttttatacccgcgcggggcctttgcttttattataaaaccgcggcgaaccgagcgtgcggcgacctcacgctggcaggccgcccagcgcgacaacagcagacgcctccatccaggcagacgccatctcgaacgagctggcggcgcggataagcgcgatagtacgagacgcacggcgcagggctgcgtctcgtggatggtacgggatacgactgggacagctcgagacgtgcgtgcgcagcgctgtcgaactgaagcagcaaacacgacgcacactgcgacgaacaactgaaattacaccgacgaacagtgcggaggctgcgcagccatccaagcgagcgctgctcccggcaagccacacccgccaccgcgcaggccgccgcgactagaccacacaggtaacagcacacgcaaccacaaaccggcacgcgcacacacacctaacacacccc

SEQ ID NO: 413739 - DNA, 4933 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413740 - DNA, 731 bp, Homo sapiens
gaagaaggggaggccttgagccccatcatgggaggccctgatggagttctggctgctggagtccagcttcgaagttagacagccctgagctggacgcaaggctgcgaatgtcccttactgtatgaccctgggcaaacaacctgcctctctaagcctcagttaacacacctgtaaaggagagaatactgtcctcccagggcaggtggggggcttaggggcatgcatgaattcggggacatcgagttcttagcaggacccatggcacagagtgttacgttattatatcatttccagattcttaccagaatctttccatttctgtctcctggggagctgatgcacagggaggtgggaagacaaagccctttgacagccgtggggctgtggggtcaaagtcgggacctgcaccaggacactgggagctgggccttgcctttgtttcttgccctgtctcaatgtggggactttggagccgttgtcttcttaacccctcttatatgtgagagattaccaaccacccagccatctctccaggacccagtttcctttcctgtccaagcgcagaagcttggtacctccccagcctgggcaatggcatctggaggttccttctcctcaggactcaccccctccctcccactcctgcccccagtgctgttcaaggaggtcaacacttgcaacccgtccaccatcacgggcacactatcccgcctgtccctggatgaggatga

SEQ ID NO: 413741 - DNA, 279 bp, Homo sapiens
ggtccgcaacttctgggcctgggttggggggaaggtgcagcgggcagacccctgggatgccaggcttcctgtctctaaagcccctgccggtggtaaaaagctttcttctcctccattgcctccttgttgctccttcccagcgaaagaaattacggtattcagacctggactttgaggtaagggccatgtgtgtgctgggcggtgggacatctggctgtggtgtctgtccctggagggctcactcctaaaagtagtccaagctctgttgcagagcctgac

SEQ ID NO: 413742 - DNA, 407 bp, Homo sapiens
gggggccactgagaacaggggtcaggagccccaccctggaaccaggcaggtctgtatttgaattctgcttgacacctgattgctccataactttgggcattaccagccctctctgggactcctcagtttgatcgtctgtacaatgggtaaggatattggcccatctccacggcccctcccgctccctccacaggataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatat

SEQ ID NO: 413743 - DNA, 5139 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413744 - DNA, 1766 bp, Homo sapiens
catctcccggcttcccatgtgtttcccctccttctcccatgtctgtgccgcccccgaggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgga

SEQ ID NO: 413745 - DNA, 5232 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggccggaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgagaaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtggatgggaaaaaatatacctcatttattttttttatttatttttctttctttcttctcctcttatattattctactttaatttttctttctatttt

SEQ ID NO: 413746 - DNA, 4142 bp, Homo sapiens
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccggggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctcgcccctgagttagcagctcgcccctgagttagcagctcgcccctgagttgggtaccgag

SEQ ID NO: 413747 - DNA, 1325 bp, Homo sapiens
actaggaaaaaaaaaaagagaaaagagaaaaaacaatatttgccatgtttatttatatttatttatttatttatttattgctgatgaattataaattctaggcatcatatttcaccccgaaaacttcagcatgcatctctgaaaagtgatgtctttctccatgaacaccctccattattatgtctgacaaaattaacaatagttccttaatgtcatctatgacctaagccatcgtcagatttccaccttatcctaaaacatctctctcacagctggtttgtttggttcaggatcccatgcaaggtcatgccttgtatctggctgtctcttcaatctcccttgaagagccccgccctttccttctgcctggacattgactcattgcctgcctgcaaggtgtttgtttgcttccttgcagcagtgttttcatgttcttctaaccctggtgttacgtgagaactggtaggcaggtctgcaaggtttaggctggtgagatcaacagggctcagtgacagatgaggcaaagccagcaggaggcaaggatgattctaccttgggtgacagaagtagatgtcactcagatgctgagaatggggagggaggagggagaggacaaatttgatttggggcacacagctttcaacatgtacaaaggacatccagatggcagtgggctatgtgagcctggagactgtgctgcgagttgttgatctacagccagtggggctgggctctcccaaggcggtggagtgagaagacaggtgagacaccaagcatgaggccgtggcggaggagatggagcctggggcccaactgctgagcagtagcagagaaaaagaaggaaaaccaggaggcctggcccgagaaagcccaagaaggagaggattttaaagagcaaacactggacagaagtcaggccagaggaagattgtcaggcctctaagccggagcaaggtccttgtaacccctgtgacctgcccgtatacatccaaatggcctgcaggagccacaaagtctggagcagccaaaaaaaaaaaaaaaaaaaaacccacaaaaaggagtaaaacagccagctccttgcattgtccctgccccaactcatcaattgaccttgtgacaatctcctcctggacagtgagtctcaggagctccccactgagcaccttgtgacccctcccctgctatcaatagataaccacctttaacttgtacctttccactgcctacccaagtcctgtaaagctgcccctattctatcccccttcgctgtctctctttttggactcagcccatccgcacccggatgtaaataaacagccttgttg

SEQ ID NO: 413748 - DNA, 734 bp, Homo sapiens
cttaagtgaggggacagagaagttggctcgaaaaggaggaagggaaaaaggatttagttgttaaaaggggatgctggatccagggaacaaactttattttatttaatttttttttttttttgagaccaagtcttgctctgtcacccaggctggagtgcaatggcatgatctcgtcttactgcaacctctgcctcccgggctcaagtgatactcctgcctcagctgctgagcagtagcagagaaaaagaaggaaaaccaggaggcctggcccgagaaagcccaagaaggagaggattttaaagagcaaacactggacagaagtcaggccagaggaagattgtcaggcctctaagccggagcaaggtccttgtaacccctgtgacctgcccgtatacatccaaatggcctgcaggagccacaaagtctggagcagccaaaaaaaaaaaaaaaaaaaaacccacaaaaaggagtaaaacagccagctccttgcattgtccctgccccaactcatcaattgaccttgtgacaatctcctcctggacagtgagtctcaggagctccccactgagcaccttgtgacccctcccctgctatcaatagataaccacctttaacttgtacctttccactgcctacccaagtcctgtaaagctgcccctattctatcccccttcgctgtctctctttttggactcagcccatccgcacccggatgtaaataaacagccttgttg

SEQ ID NO: 413749 - DNA, 2503 bp, Homo sapiens
  misc_feature (12)..(12): n is a, c, g, or t
  misc_feature (37)..(37): n is a, c, g, or t
tgttgcgttcgnagaggcgcagcatccacagggaagnaggcgcctccttccctgcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413750 - DNA, 2496 bp, Homo sapiens
taacttaggctaggtacgaggctgggtttaaatcggccgaggctgagcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413751 - DNA, 2543 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggtgagtctcctgggccagtaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413752 - DNA, 2422 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccgcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413753 - DNA, 2677 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctggtgaggcctcattttccagagctcttcccctcccatttccccttcttgcccagtagaaaactgtatcagaaggctttattttctctcaccgcaccccttcactgcccaccttcctggttctgccttccagccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413754 - DNA, 2202 bp, Homo sapiens
tgatctagaggatcccgtaggtcaagtgatccttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtggtggggagcactaagagctgtccatttctccctttaaagagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413755 - DNA, 2473 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413756 - DNA, 1630 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggattgtgggtgagaggggtttgtggtggg

SEQ ID NO: 413757 - DNA, 819 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacggtgagagtgaggggaggttgaactaactgcccccctgtgcttttctccgcccccaaccatctgctgcctgcagcttagggctcctacgtcttttccacaggacaaggttgtaggagctagttgatgtctttaccgagggcagaagagcccatgatgggggtggggaggaggttggagggttctccctccaagctcttgggtagggtaggaagcataagagcctggagctggacagacttgctttcacccccagttttgcaacttgctaaccagctgcatgatcttgtaagagttggttatctgtccccagcctcgtctatgcctctgtatccttctacgtgagttttgttttgttttgttttgttttgtttttagtgcagggaagataatagccatctatctgcagta

SEQ ID NO: 413758 - DNA, 2547 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413759 - DNA, 2657 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatggtgagtttgaaatggggcaccctgactttaggatgggcaggggtggtagcatccaagttcctagttctccagcccttcaatcccaagtgtgtgctcccctgcttctccagaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413760 - DNA, 3396 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtctcctttgcctcatgtctgctgctccctgggcagtggttgcctcctactgagggctgtggactctcggattggcgttttcctatggcacttgtatccctcacgtgtaggaagcaatagcagcaccagccttgcctctagaagagacattgtcaagctactggggcatggaggtcatctgcctgcctgaccttggggtgggctgagccagtggaatgaagggcagtgtattggcatcattgcggtgctgttagccctagcctgggctcagcctcagctgaaggggtcttgggttctgtcgtcacagcccccactgatgggcagttgaactgattgtgtaacctggcctcacacgtggccagctgctttctccagtcatatctggctccggcttgccctgcttctctgctctctagactcagcactgaagagaagccatctttgtcctcactttgcttgggtgattgcatgttctttatatttcctctaaccatataggaggggcctgggaaatagggaatttaggacagggtctaacaggaaggcatggaacactttcttttcaaatgaagcaatctttaagaggggagagatgttgaacacaggtagtatcatttataaatattatttcttgaggagttagctgttatatgtcattgttatgcagaggacgttaaaatagagacatttgagctgagcacagtggtacgcacctgtagtcccagctgttggggaggccaaggtgggaggattgcttgagcccaggggtttgcggccagcctgggaaacttagcaagaccacttctctcaaaagaaaaaaataaaacagacatattgcgttgctctcagtga

SEQ ID NO: 413761 - DNA, 2239 bp, Homo sapiens
cttttggggggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413762 - DNA, 3186 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtcaaaacaaagaaaaaaacaaaaaaaaaaaacagcaaacacagcgagaaccaagcgagggggcgcgccaaaaagataccccagggggggcacaacatacacgggtagccacgattttggcacaacgggggcccccaaaaggggacgcaaatacaggcacaccatggcgcgcgatatcacacaccgggagactgccgaacacgcgtcccacggcggaacacacctgtggagagagacccacacacgcgggggagaccacactgggcgcgcacacacccacaggcactataaagcccagaggacaaaccacacccacaggcgcaagcggcgcaaccaccgggcatctccggcggcgacacaagctgcgacccagcggatagtcatgcaaaatcacaagaggggggggacgtcgacaacaacgaaccgcaagacgacgacgtgacaagccacaggaaaggcagacacaacgacagaagcgaagacgccaagacagaaagtgagcgagaacagcacgagcgaccgaataccaccaaccgacagacaacacacacagcaagacagagaccacacagagacgaagaaaagaaaaccacgaggagcacacagaacaagcgacaacagaagaacacgacggaaccacag

SEQ ID NO: 413763 - DNA, 2338 bp, Homo sapiens
cttttggggggatttctgactatgtcttttcctgagcctttgagtctgttcatcatgggtaagttaagagggtttactcgagatgttctctcttggggttcctttctgagcctacacccgagagtgaagtcgatgtgtttggacccttagacagtgaatgcaaagaagttagagaaggccgaggctcgacttaaggcaaagcaggagaagcgctcagagaaggacacgctcaagaccagcaaccctctgtgagtgggggaagcatggctcagaagagagcagagcagcttttgcctggacagaaggtggtggggagcactaagagctgtccatttctccctttaaagagtcttagaagaggcatcagccagccaggcaggcagcagaaaggagagtcggttggaatcatctggcaagaacaaatcctatgatgtgcgaattgagaactttgatgtgtcttttggcgatagagtactgctggctggagcggatgtgaacctggcatggggccgccgttacgggctggtggggcggaatgggttggggaagacaacgttactgaagatgctggccacccggagtctgcgggttccagcccacatttccctgctgcacgttgagcaagaggttgctggagatgacactcctgccctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413764 - DNA, 1181 bp, Homo sapiens
gaatggactctaaagtaatgatacctgagtggtaggagtacaagccctttctaagttttctctgaacacatattactcgtgtaggaagttatttttttaagtaataaatctagtctacctcatctcttctcccaggcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413765 - DNA, 1830 bp, Homo sapiens
ttccgggacatcgtcgacccgggcgctacgggcctgcagagtgtgctggagagtgacagtgtgcgagaggatttgctacggagggagcgggagctcactgcccagattgctgctggcagggcggagggctctgaagctgcagagctggcagaaatctatgccaaactggaggagattgaggctgacaaggcacctgccagggcatcagtcattctcgctgggcttggctttacccctaaaatgcagcagcagcccacccgggagttctcaggtggctggaggatgaggctggccctggcccgggccctctttgctaggtgagtctcctgggccagtgtatgaagccctatggaagattggtcttagctcttgggaggtggcatgagttgctgacctaaaacctcaggccatgtattctttttcataggccagatcttctgctgttagatgaacctacaaacatgctggatgtcagggccatcctgtggctggagaattacctgcagacgtggccctccaccatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtctaccatgctgaagctgcttttgggggacctggcacctgttcggggcatcagacacgctcacaggaatctgaagattggctatttcagccagcaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413766 - DNA, 1849 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctggctgagccacaaagccagggaaatagccaggtgctactggacgcccctatccagttgtcaaagataacggagaactacgactgtggaaccaaacttccaggactgctaaagagggaacagtcctcgacagtgaatgcaaagaagttagagaaggccgaggctcgacttaaggcaaagcaggagaagcgctcagagaaggacacgctcaagaccagcaaccctctagtcttagaagaggcatcagccagccaggcaggcagcagaaaggagagtcggttggaatcatctggcaagaacaaatcctagtcgtctcccacgaccgcaacttcttgaatgccatcgccacagacatcatccacctgcacagccagcggctagatggttaccggggagactttgagaccttcatcaagagtaagcaggagcggctgctcaaccagcagcgtgaatatgaggcgcagcagcagtatcgccagcacatccaggttttcattgaccggtttcgctacaatgccaacagggcctctcaagtgcagagtaaactcaagatgctggagaagctgcctgagctgaagcctgtggacaaggaatcagaggtcgtaatgaagttccctgatgggtttgagaagttctcgccgccaattctgcagctagatgaggtggatttctactacgatccgaagcacgtcatcttcagtcgcctctctgtgtctgctgatctcgagtctcgcatctgtgtggttggagagaatggggctgggaagtccaccatgtggagcagctggacctaaacgtcagtgctgtggaactgctggcacgcaagtttcctgggcggcctgaggaggagtaccgtcaccagctgggtcggtatggcatctccggagaactggccatgcgtcctcttgccagcctgtctgggggccagaagagccgagtggcctttgctcagatgactatgccctgccccaacttctacattctggatgaacccacaaaccacctggacatggagaccattgaggctctgggccgtgccctcaacaatttcaggggtggtgtgattctggtgtcccacgatgagcgctttatcaggctggtgtgccgggagttgtgggtatgcgaaggaggcggcgtcacccgtgtggaaggaggatttgaccagtaccgcgccctcctccaggaacagttccgccgcgaaggcttcctctagggccaccaggctgaggactcgcccaggacatggactggtctctcagacccctgggccaccatgtaggccaccactccaggccgtggacttcccccaacttggggacagccttattcccaaatgtctctatccttttgactggagcatcttctgcacaaccttgggagcccatccaagggttggtgaggactggtctcccgggggtgggggtctggggggtaccctctggggttatagattcccccactgccccagctctgactggaccccaagtggctgctatgtaaattaaatctctccccgcgtc

SEQ ID NO: 413767 - DNA, 960 bp, Homo sapiens
accgctacacatgcgccttgcaaggaagggcgagatttcgggggcggggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggtggaagctgtaggggaactattgcaagaggtgtccggggacagcaaggatgacgcgggcatcagggccgtgtgccagcgcatgtacaacactctgcgtctgtatgtgccagggagtaggggttgatgggggcgaagggacggcgaacggtccggagacaagaggtgggggaggaagatctgatggccatagagcttttccctcaactcctaactctgcgctttctatccctacccacatagggctgagccacaaagccagggaaatagccaggtgctactggacgcccctatccagttgtcaaagataacggagaactacggtgagagtgaggggaggttgaactaactgcccccctgtgcttttctccgcccccaaccatctgctgcctgcagcttagggctcctacgtcttttccacaggacaaggttgtaggagctagttgatgtctttaccgagggcagaagagcccatgatgggggtggggaggaggttggagggttctccctccaagctcttgggtagggtaggaagcataagagcctggagctggacagacttgctttcacccccagttttgcaacttgctaaccagctgcatgatcttgtaagagttggttatctgtccccagcctcgtctatgcctctgtatccttctacgtgagttttgttttgttttgttttgttttgtttttagtgcagggaagataatagccatctatctgcagta

SEQ ID NO: 413768 - DNA, 6445 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtaaattttcaggcgggccagcattggaagcacaggctggtcctgattttgcaacccaagtgtcatcgtgatgagtgtttgggatccacagccatgatggatgggtctcatctcaattaatagaaggctgctcttacccttattttgcacttaaggctcactgagacacagatgttaagtaataccctatgattacacagcttagtacacatttgagcagtgtttattgagtatctgctgtgagccagagagcagaaggaagtgagggagcaaggcatacagtcatctggggacacctgttccagagagggacagcaggtacagaggccctgcagcagggcaccctggcgtgttcttagatacaccagcagcccatgtggccggagcagagtcagcatgaggtctgtgacctaccttttttatttttgagacagggtcttgctctgtcacccaggctggagtgcagtggtacaatcatggctcactgcagcctccacctccttgactcgcagtcctcccaccgcaccttcctgaatagctgagactacaggcgtgtgccaccacacccagtaattttttttctcatatgtagatacaaaaggatattcttaaaatttttatagagacagggtcttgctgtgttacccaggctggtctcacactcctggcctcaagtgaccctcctgtctcagcctcccaaagtgctaggattataggcgtgaaccaccacgcccagctggttcctgaggaagtcagtgtgggaatactttttttttttttatacggagtctcgctctgtcacccaggctggagtgcagtggcacgatctcggctcactgcaagctccatctcccaggttcacgccattctcccgcctcaacctcccgagtagctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413769 - DNA, 215 bp, Homo sapiens
ctgggaaggtgatcattgacacccaggcctcccaggaaggagagggtgagaggtgtggacactggagggagggtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413770 - DNA, 4619 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413771 - DNA, 3481 bp, Homo sapiens
ctgctgacaagctctgtggctccccaggagaactgtcccaaggcccagggctctggtctgctgaggtgtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413772 - DNA, 4028 bp, Homo sapiens
agtcagggggcggggcgcgggccaccgggcccgggggatcgggggagcagccgggggcctcgggagccgaccccggtccgaggggggcctaaaactcctcgagagcaaccggagccaggggcgggcggcggctcggaccgcgtccccgggggcggggaaagagtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413773 - DNA, 4917 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatccaaaaaaaaaataaataaggatacaacaaacacacaaaacacaccacaccgacgcaaaacaaacaaacagaaacacaaccaaaccaaaaccaaaagcacctacatcacagcgcaaccagcaaaccccacggcacgcaccaaaacacgaaggacaccaaaggatcttcgagagccgcgaaccaacccaaaaacaaccatcaccagcgagccaacaagcatcactccaaccaccgccgaacacctggagcacaactcacacagacccacgcgcccacatcaacaggtgaacacccaacacgc

SEQ ID NO: 413774 - DNA, 1870 bp, Homo sapiens
ccaggacttcctttagaagcagtgggactcctcacgcgcaggcccagcaagggcttgggcacccgcagctgtctgcttggctgggtgtcaatgatcacctcccagggcctcccgggaaggagagggtgagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413775 - DNA, 3884 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413776 - DNA, 788 bp, Homo sapiens
ctccatgacataaagtgcaaggtgaagcagcaagtgatgatttagaagctgcagcaggttatccagaagatctaccaaagaccattcatgaaagtggctacagtaaacaactgatttttaatgtagatttaaaagccttctattggaagaagaaggcgccttttaggagtttcttggctagagatcagaagtcaatacctggcttcagagcttcagaggacaggcagcctctcttgtaaggggctaatgcagccggtgactttacgttgaagccagtgttaatttaccattggaaaatccatgaggaccccggaggcttaagggacccttggcccaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413777 - DNA, 422 bp, Homo sapiens
gtcagtgacccaggggaggactctgctccagccctgcatgtgtgcacttcctcctcgctctgagcagttgtcctcctgctgccccctccacagggatgactccgctgaggtggacgtgtacaacccgacgaggaacgaatgggacaagatcccgtccatgaatcaggtaaattttcaggcgggccagcattggaagcacaggctggtcctgattttgcaacccaagtgtcatcgtgatgagtgtttgggatccacagccatgatggatgggtctcatctcaattaatagaaggctgctcttacccttattttgcacttaaggctcactgagacacagatgttaagtaataccctatgattacacagcttagtacacatttgagcagtgtttattgagtatctgctgtgagccagagagcaga

SEQ ID NO: 413778 - DNA, 3933 bp, Homo sapiens
cacagtgtatggactgggctcttgaggagcacgagggagaggccaggcagccctgtcaggggtcctgggactacaggtacccaccaccacgcccagctaattttgtttgtgtatttttagtagagacgggatttcactgtgttagccaggatggtctggatctcctgaccttgtgatctgcctggctcagcctcccaaagtgctgggattacaggcatgagccaccatgcccagcccactgtgggaatacttgtgttgagcacttgctgtgtgttctgaataggacaaccagggtccaccccttctctctgggcttgttgagaagaggggtgcccagcctgacagtgatgggacagggaggcttcagtgccatttggccatgtgagcagtgttagtctgaggtacacatcatattgcctacagccttctttcctgtgtgtctgttaacatttccaaacctacactccgtgacatccagcctcacagcttacatcacagcttaatgtcctggcatttaagagacccagcgttctgttttccccgcagtaagctgcacatagtcatagcgaatttgggaaagatggaaggaatcatccagcctcgcggttcagagcccagctctgccactgtcagccatgcaagcctcagttttcccatctgtaacatggggagaacagcactgctcagcccagagggccactgcagagattctgagagagaacgtaggaagcgctgctcggcacgacctgcacacggggaggcctggcgctgcagcgggcaccctcatcaccatagggaaggcccagctgcctccggggaggcccgttctcctaggcagggtgttggaaaggggttggcctctctgctgctttctgggagagccaaggccacccctctggggtactgacagggcatgccttgtctccagtggttccccaggtggggccctgccctaccctctcctctgacctccactcactcatccctttggcccacaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagtatggggaaaaccaggcaccagcctctgcagcaatgggtccctctagcctgtggacaccagctgggggatccagggtcaggccccctcctctccccagtttccctctgctgtgggttctgggctgtcatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413779 - DNA, 3599 bp, Homo sapiens
cgcgctcgcggggggcggtggcgcccggcacagaggggttaagggggcggtgcagacgtctccccgcccatcccgcccctcgagagccgcggcgccccgccctatttatagcagcggtgcctagcgcgccgcgtctctccgcaggccccggccgcggcgtcctcgacaacctatcgaaggcgccatggagcgaccggcgcccctggccgtgcttcccttctcggaccccgcgcacgccctgagcctgctgcgcggcctgagccagctgcgcgccgagcgcaagttcctggacgtgaccctggaggcggcgggcgggcgcgacttcccggcgcaccgtgcggtgctggccgccgccagcccctacttccgcgccatgttcgcggggcagctgcgcgagagccgcgccgagcgggtgcgcctgcacggagtgcctcccgacatgctgcagctgctgctggacttcagctacacgggccgcgtggcggtaagcggcgacaacgctgagccgctgctgcgcgccgccgacctgctgcagttcccggccgtgaaggaggcgtgcggggccttcctgcagcagcagctcgacctggccaactgcctggacatgcaggacttcgctgaggccttcagctgctcgggactggcgagcgcggcgcagcggttcattctgcgccacgtgggcgagctgggcgccgagcagctggagcggctgccactggcgcgcctgctgcgctacctgcgggacgacgggctgtgtgtgcccaaggaggaggccgcctaccagctggcgctgcgctgggtccgcgctgacccgccgcgccgcgccgcgcactggccgcagctgctggaggccgtgcgcctgcccttcgtgcgccgcttctacctgttggcgcacgtcgaggccgagccgctggtggcgcgctgcccaccctgcctgcgcctgctgcgcgaggcgcgcgacttccaggcggcgcgctacgaccgccacgaccgcgggccctgtccccgaatgcgtcctcgcccgtccaccggtctcgccgagatcctcgtgctcgtgggcggctgcgaccaggactgtgacgagctggtcactgtcgactgctacaacccgcagacgggtcagtggcgctacctggccgagttcccagaccacctgggcggaggctacagcatcgtggcgctgggcaatgacatctacgtgacgggtgggtccgatggctcccggctctatgactgcgtgtggaggtacaactcaagcgtgaatgagtgggcggaggtggcgcccatgctgaaggcccgcgagtaccacagctcctctgtgctggacggactgctgtacgtggtggccgccgacagcaccgagcgctatgaccacaccactgactcctgggaggccctgcagcccatgacctaccccatggacaactgctccaccactgcgtgccgtggccggctctatgccatcggctccctggctggcaaggagaccatggtgatgcagtgctacgacccggacaccgacctgtggtcgctggtggactgcggccagctcccgccctggtccttcgcccccaagactgcgactctaaacggactcatgtactttgtcagggatgactccgctgaggtggacgtgtacaacccgacgaggaacgaatgggacaagatcccgtccatgaatcaggtacatgtggggggcagcctggccgtccttggggggaagctgtacgtctctgggggatacgacaatacatttgaactctcggacgtggtagaggcctatgacccagagactcgcgcgtggagcgtggtggggcggctcccagaacccaccttctggcatggcagtgtcagcatcttccgccagttcatgccccagaccttctcgggtgggcgtggcttcgagttggacagtggcagcgatgacatggacccaggccgaccccggccgccgcgggaccccgatgagctgcactagccccagtctggcccggcacgggcctcggtgcaggtaactggcacctctgcggggcagtgccccactcctttgtgcacaaggacacgttgggctcacaggaggagcacaggctcttgggtggcgaagccagcccaggatccattacctggaaggtttctgtaccttgagagcctgaatcagaggccgtcgggaacgccctccctgcagttgaggaagagccactttcctgccagcacatgtttctgggtcttggaggtcacccccaccccgcggatcacagctcacccacgcggcgcacacccctcctgccgttgtcatctgcacctacttgttcccaccttgggagaggacgatgacttgggagggacgcgtgaagggagaaggggtcctcccatgaggctgaggatggcctgaacctggagcagcggaccaggcagacgggctgaagtggggtcccaaattccatgtccagaggtgtggggagcctgcctccctagctcctggcccctgccaggggcttacatcaaaacacctcagagggctgccctccagaggctgcacccagaacagtgggacatgagcaggggtgtgggcttggagggtgaagaggatgtggtcctatcagatgctgggcctcctcagccatagccccctgctcctaccccctgactggctcttgcgtcctcacctctcaccctctccttcccgggaggccctgggaggtgatcattgacacccagccaagcagacagctgcgggtgcccaagcccttgctgggcctgcgcgtgaggagtcccactgcttctaaaggaagtcctgggcaggaggtggctttggtggttggttccaaagttgaaaatgcttgcagtttgaccttagaagaagtgggaagaagaaggagctctacagggtcagctttgtttgatttgtccagtctaagaagtcccattgccaaagctttctgcaggagggtgaatgccgcagcttggcagcccctgggtttctcttggaaatggtcagtttcccctcaaagtacccaaagtagccttggcttgagtttttgtccttgcctcctttttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtctccaccacttaaggatgtctttacactgacttcaggatagatgctgggatgcctgggcatggccacatgttacatgtacagaactttgtctacagcacaaattaagttatataaacacagtgactggtatttaatgctgatctactataaggtattctatatttatatgacttcagagacgcgtatgtaataaaggacgccctccctccagtgtccacatccagttcaccccagagggtcgggcaggttgacatatttatttttgtctattctgtaggcttccatgtccagaatcctgcttaaggttttagggtaccttcagtactttttgcaataaaagtatttcctatcca

SEQ ID NO: 413780 - DNA, 4986 bp, Homo sapiens
  misc_feature (3)..(3): n is a, c, g, or t
  misc_feature (10)..(11): n is a, c, g, or t
  misc_feature (14)..(15): n is a, c, g, or t
  misc_feature (19)..(20): n is a, c, g, or t
  misc_feature (2319)..(2319): n is a, c, g, or t
  misc_feature (3159)..(3159): n is a, c, g, or t
gtntctctgnntgnnttanngctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattacataagttgc

SEQ ID NO: 413781 - DNA, 4844 bp, Homo sapiens
  misc_feature (3)..(3): n is a, c, g, or t
  misc_feature (10)..(11): n is a, c, g, or t
  misc_feature (14)..(15): n is a, c, g, or t
  misc_feature (19)..(20): n is a, c, g, or t
  misc_feature (2319)..(2319): n is a, c, g, or t
  misc_feature (3159)..(3159): n is a, c, g, or t
gtntctctgnntgnnttanngctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttcca

SEQ ID NO: 413782 - DNA, 5042 bp, Homo sapiens
  misc_feature (3)..(3): n is a, c, g, or t
  misc_feature (10)..(11): n is a, c, g, or t
  misc_feature (14)..(15): n is a, c, g, or t
  misc_feature (19)..(20): n is a, c, g, or t
  misc_feature (2517)..(2517): n is a, c, g, or t
  misc_feature (3357)..(3357): n is a, c, g, or t
gtntctctgnntgnnttanngctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagacccacactcttcttcatataatcacccagtcttgtctctcagtgaacaaagtagctgatggctcccagcatcctactgtggaaacctgtaatgatagcactttgcaaaaatggctactaagaaactatacaagaatggaaatttttagaaatatttttgggaattctactgattacattctctaatgatttttggagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttcca

SEQ ID NO: 413783 - DNA, 1143 bp, Homo sapiens
  misc_feature (3)..(3): n is a, c, g, or t
  misc_feature (10)..(11): n is a, c, g, or t
  misc_feature (14)..(15): n is a, c, g, or t
  misc_feature (19)..(20): n is a, c, g, or t
gtntctctgnntgnnttanngctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttagggtaattgcattttattttattttttgatgctgaacatacaatgctgtagcatgcacataccagtcccagtaatttactgtcaaatcatttttgctgagtgatgcaaattactgatcaattggttatcttaattcacattttgatttgacagagtcctattgcatgcaatattttcttctaaatgggaaattataggtaatttttgttttcaaaaatattgtttttattcacagtaaaaatacattaggactttcaattgctgaaataaagaagggttttattttttaat

SEQ ID NO: 413784 - DNA, 3608 bp, Homo sapiens
  misc_feature (26)..(26): n is a, c, g, or t
  misc_feature (38)..(38): n is a, c, g, or t
  misc_feature (1083)..(1083): n is a, c, g, or t
  misc_feature (1923)..(1923): n is a, c, g, or t
cctagctggagacgactctctaattnccaccgctacangtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctccnagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttanatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttcca

SEQ ID NO: 413785 - DNA, 1966 bp, Homo sapiens
  misc_feature (3)..(3): n is a, c, g, or t
  misc_feature (10)..(11): n is a, c, g, or t
  misc_feature (14)..(15): n is a, c, g, or t
  misc_feature (19)..(20): n is a, c, g, or t
gtntctctgnntgnnttanngctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatctttattgcactcatgtcatagggttaattggaggttattttatttttggttgtcatggtgattgaaagagataatgtaaatgccttataaaatcttcattatgaaatattatcagttgctttataaactcactctttttatgg

SEQ ID NO: 413786 - DNA, 482 bp, Homo sapiens
gttgctgctggtagggatggttaaaaatacctcagctcttatcccaggatagtgaacaccaggaaggggaatgactgctatggaaataggcttcaccaaatcttgaactattaggatgaaggagaagtcttggtcaaaataagttgaggttatatacgaggagaaactgttcacatagaggcccagacactggtgaactggtgggagaaatagaaaggcaaggcatatccgtgatttgaaatgagtggcacatctgtaagcagcttctactggaaatgaagaccttacctgaccttctggattcatggaaaggaatggccatatcctcccatgtgaacagaatattccatgtgcttgtcccattgtcataaagagcatggcatagatgatcatgaatgaagatctgggatggctatcctatgtcccatgcaatccgggccacaagtcacttgtattacttaaactccacatagcgggaatag

SEQ ID NO: 413787 - DNA, 256 bp, Homo sapiens
taccttaccattgtgcctgttatgttcaaaaatacattttgaaaagttcttaaaataattgctctaaattgaaatgtcaaaacctgaatattctacatgtgtcttggtgatgtcctttaagctaatcctataatacactaagtacatttaattgtgaaatgtcatttcacaagctatgtaagcatccctcgaagcctgcattttaatgtctagttttcaattttatgcacctaaaatatcctatgtgatgatatta

SEQ ID NO: 413788 - DNA, 294 bp, Homo sapiens
ggctgaggtgcccagtgctggggcaaaatggggactcaggagaaatgtctcgttcaacctggagacagacagctaccttccttctcccttgtacccactcaccagatcctccaggcctctgctggaggtggacgaagggctgcagccccacccagccaggcaggactggagacaggaatgctgctgagcccagctggccagaaaggggtgactgtttgttctctgatgtgaggaacatctcaggcaatcagggggatttggctgccagcagcccctggatgcaaggtctcaaaa

SEQ ID NO: 413789 - DNA, 558 bp, Homo sapiens
gctgagcaggatgtgttggcatcacctggatgcagagtcgggcttcctggcagtggcccagtggctggcagaaccccacacatgaacactgagccacttttcctatgcaagccctaacccctaatgccggagagacccacaatggaacacacacccagacggtgcttcgggttggcttctcctgacccccctccccaagccacctcctcccactgggacgccaggtctgaggaggcagctctgaccctgctgtggccctcacaggctctgccccagcccctctcccatctcggaggcatggggctgtttcctggtgtcccccattaccaccttcctgtgtccgagactcctgcccaaaaggctagagccccagcctgctttctccaacaccctcgtgggatttgtgagggaccctctgggaggaggtgtgaggtcaggaccccctgcccaaagggagtccatgctttcccatcccactcctctcagcagcaccgccgcccgattccacagactccaaaatgtctccaaatgaattaaagaagccacggtcaacccaca

SEQ ID NO: 413790 - DNA, 203 bp, Homo sapiens
ttggatatctgcctttaagtagtaatgttacaatatatagtacacacaagagaattggtatccttgtctgtaaattgagaagttcacagaaaaggttgatgaaggtctgatcaggggcgaaattgttttgttctaaaatatatcattggtagcaagcagtttaggtttggatgaaaccaaaagccagttcgcatgtgtgtaga

SEQ ID NO: 413791 - DNA, 487 bp, Homo sapiens
gccaatgcttctcccgtcctttgcatggcacccaagaaggagaaaggaggaactgtgaacaccagttctaagatatgggaaccctcgctcatagctgcacagttcaatcagaacgattggcaggcctccattgcttttgtggttgggaaccagattgaagatgatcttctcatccaagcccttaccgtggctgtccaggtccctcagcgtaaactcttcagtatggtgtcgtggcaagacattctccagcagattaatgaaataaatacacttgttggatctgcttcatctaaaaaggcaaaaaaacctgtaggtggtaatgctcctttatattatgaggtaagtgaaagtgtttatagaagatatttttgtgtttttagaaaaaagaattgaagtaataatttgatagccatttttaaatttcattctttgaaaataaatgcctgctcctcattggagatatttgttcctgatggtgaacacacac

SEQ ID NO: 413792 - DNA, 803 bp, Homo sapiens
tagagctccctatttgtgtggctcaacgtgcaaggggccccacagcatcccggagctccacggaggtgaccatgtgccactgcctgcttgtgcccagttaaatggattcgggaactctgttagcggatttaaatagtggtcacaaaacaaatagtaacaataacaataattcttctgctgcaggataactggcccttgatgcagctcagcatcatgagtggttctgggcttaaagagattaaagaaacataaaaccaaatgtggcacaagaacccttatggtgtcctaggttgggaggcttataaaatcttccacaggacaattcaagaaatgagtggggacttgtggaagattcattttcttaggtgcagcaataggactgtggttgtgtggttttaggagccagtatcctggagtctgcaggggaggggctcccagggtggtagggcagagaggagccaagcagcagggtgcggtcagcaccgaggtggctcgggtgcacgcactcctctctccatagtggaatcgttttaaaaattcctgtaccaaaagcaagctgcagagtgaagacagtactgagtataaaacaagctagcaagagcacgtctagcccagcccagcccaccccagcctttctcctgcctggggacatggtgcaaagcagaggggtcattggggtctgaggtgttggcccccccaaaaatacccaaaaaaccatgggaaatggatgtaagtcatttgttactcattctgaacccttccctaagaaaatattgtacctgagaatatcagctaatgatggt

SEQ ID NO: 413793 - DNA, 269 bp, Homo sapiens
atatttaaagagagctttggtcagtaaaagtataaaatctgagctttggtaagggtacagtttataaggcctagagaacatcaaaacattcatttcatattgaatgtataaatacccacatgtgagagcacatgttgattcagtttgagtatgtctgccttgtggatctttaaaacctttccagcctgtgttattttcccaagctttctttataattacaccagggaaagagttacctggcattaatcaaaaccagacagtggacaatg

SEQ ID NO: 413794 - DNA, 186 bp, Homo sapiens
tttcccttatatcacataattattaactatgtaatatatgtttactattaaatgtataataataaataatagcaattctacctcgctccaaattgaggtcatcaggaaggacttcccaaaaagaggagacttgagtgagaaaaggggttaaggtctgtctttcttgtttttttttttttggtttta

SEQ ID NO: 413795 - DNA, 303 bp, Homo sapiens
gaagggccctgaccgaggccaccagcttgtaagtagcagccctaggcttgggaccagggcctcctgaaggtgacagtcctttcagccatgtgtccttgttcctctagttacctccaattaactctaggtaacccagcccagtctttgattctgtgttgaaaggtgcgaggtgctggagccgggaagaggtgcgttcttgctctcgacaggaagtgtcatgtgagtttccggttccctctcctccactaccactctggatcctcacaccagcccacagagggagacaggaagggaggcacaaag

SEQ ID NO: 413796 - DNA, 232 bp, Homo sapiens
cttttagcagagacggggtttcaccatgttggccaggatggtctcttgacctcgtgatccacccgcctcggcctctccaagtgctgagattacaggcatgagccaccgcgcctggcccagggaaggcatttttgaagaaataatagttgaattgagatctgataaaagaagtaggagcaaaatggggggggtgcagttttccaagaagagaagacagtacatataaagggct

SEQ ID NO: 413797 - DNA, 407 bp, Homo sapiens
agagaaagaaaaaaaaggaaaaataaataaataaataaataaataaataaataaataaataaaagcaaccctaacactactgaggctattgacagtggcactttgctcttctgttaggaccttgggaaaattttttccccctgaatacagtataataaacttggttcttatttctctttctctccccctccttttttcttccctccccactaccacatgcacacacacaaatagacagatttgtttatatttgactttctaaaaacctgttactagaaaggcacattaatacatttctcctgtgctgatagtaatcaggcaactctggtttctattggaggcaatttcttacgtattaaatgccagaaaaagggcatccctccgtttttgtagagagcctttcttta

SEQ ID NO: 413798 - DNA, 288 bp, Homo sapiens
cccctaatagatatacccaagttttgaagtacaagctgtgggaagcctgtgaaattgatacaagggcttaaaaaaattatttaggcagatagtgagggtaagagagacctttgtgaaatttccttttaataaaaagcagccccaaagtaatttcttttctaacaaaaagcagcctgaaaaatcaagctgcaaacatagctaagcaagcaggaagcttgcataagtaaatgccagcagctgcgccaacagaaaagggatacctggaagccaggtatgttcaacatggag

SEQ ID NO: 413799 - DNA, 960 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctccctggttttgacacagttccctctccggattccccgttggccttgtcccgagtgccgggaaaacattggagggcccggctgtggaactcttgttatgctcgccgtgccgttttttcccgcgggtccccacgggttttccccgttgcactatacagt

SEQ ID NO: 413800 - DNA, 323 bp, Homo sapiens
  misc_feature (22)..(22): n is a, c, g, or t
cattttgtttatgatatgtaancagaataaggttgagttctgagaccacactaaagcaatgagagttttgtttaataggttcttggtatttgcggtatatttaagaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcat

SEQ ID NO: 413801 - DNA, 217 bp, Homo sapiens
gctcgacgagcaatttactctgcagttaacgtggttgttaagtacttcaagagtcactaagggaaagaagctaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcat

SEQ ID NO: 413802 - DNA, 2139 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcat

SEQ ID NO: 413803 - DNA, 2159 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413804 - DNA, 2244 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcataaaaaaaacaaacaaacaaaaatcagggccgacgtaaacgtggacggaaaccggcgaccattatgctgagaacccttcgggggagagcgaacgctcggaccctgg

SEQ ID NO: 413805 - DNA, 2072 bp, Homo sapiens
ggtcatgattagtgtctctggatcctcgaccaagtaagataacgctcacggcggagatcgagatgttctgatagcaatgtgccatggatggcagttgctgaggtcataactggcacctgtatctaacatggctgtccactgcgagctcggtctggccatgtgatcgccccgacgcggataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413806 - DNA, 2105 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413807 - DNA, 2107 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413808 - DNA, 2105 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaatcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413809 - DNA, 2105 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413810 - DNA, 2114 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagagcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413811 - DNA, 2205 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagtattgttccttgtcaatctgagggccttgagtgactcctgggtcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413812 - DNA, 2103 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagagtggcaagttgatcaaagaagctgtcggggtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413813 - DNA, 2105 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcaggaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413814 - DNA, 2085 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaaacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcat

SEQ ID NO: 413815 - DNA, 2084 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtggggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413816 - DNA, 2104 bp, Homo sapiens
agcggagaagtccaggatgggaagagagatctgcagactcccagggaacctacagctttctccttcacagcattgcaggagcaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatctccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcttgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413817 - DNA, 994 bp, Homo sapiens
cccgggctgcaggattcggcacgaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgattcttgttacttttgaat

SEQ ID NO: 413818 - DNA, 409 bp, Homo sapiens
aaatgtctcaaacagccagaaagttttgagaggtgaagagatgtgcatcatttaggcatggtgaaatgctttagtttaagtttatgaaaacttccaaaattttctgcatatttaagcgccttgtatgtattttctcttcatctctacagatcttcataaacaatgaatggcatgattcagtgagtggcaagaaatttcctgtctttaatcctgcaactgaggaggagctctgccaggtagaagaaggagataaggtgagtttctgaacactagtttcattttatgccaggtttcttggttttttgccattctgagctcctgaaccccattgcaagctccaaaagacatgccatgaaaatatggtttctggggcagcttaggaaaattgtctaagttgtccttgttacca

SEQ ID NO: 413819 - DNA, 419 bp, Homo sapiens
tgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagggtaagtataaaatagaaaggatagcattttcagggcacaggaataaagtatcctctttagacctagattttattgagtaagattacttcccatctgcacaccttcctaggtgacaatgctgtgccagtttggtgtttaaaagcaatctaactcccagtgagaatgaaatcatcctgtttttgtgttgcccagttttcatgtctagaaacagtttaccggccatgctgagaattaaagacatgaggaaaaata

SEQ ID NO: 413820 - DNA, 329 bp, Homo sapiens
tcgtctcaaaaaaaaaagccatttggtgtttctcccaaatgaaattttactgtggcacaaacatcacataaatttagaatgctaaagcaacctgtgttcatgagagcagggtaagcctcctcctttgtaatgctccctttcaggttggcaagttgatcaaagaagctgccgggaaaagcaatctgaagagggtgaccctggagcttggaggaaagagcccttgcattgtgttagctgatgccgactgtgagtagaaaccactttgttaacttttcgtccttcatcgtttttggtgtctgataatgccaaaagtgaacttgaactttaca

SEQ ID NO: 413821 - DNA, 691 bp, Homo sapiens
gttgcatctgcagttcgagtttttaaaatcaagtagaataatgtcaaaaggggacaatttatgtgagaaatcaactgacagtacatgattatttaaaatgaaagttttaaagaaaattttccccacaagggaatctgtgtaagaccagaaatcttatgattggctagctactatataaaatgctctgtacacaagaaatattttctattgtccctagccagtaaaacaagaacaaactcgtaccaaacatgaactacagtatatttatactgctgtgctaaatggtgtttgtgggtatgtttttcttctctctaggggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggata

SEQ ID NO: 413822 - DNA, 1707 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413823 - DNA, 1785 bp, Homo sapiens
  misc_feature (1776)..(1776): n is a, c, g, or t
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttaaaaaaaaaaaaaaaaaaaaaaaaaaaacacacaacacaaaataaaaaaaaacaaaaaaacaaaaacanaacaaaaca

SEQ ID NO: 413824 - DNA, 1239 bp, Homo sapiens
  misc_feature (40)..(40): n is a, c, g, or t
gggattggcctcgagccaagatcggcacgagcctcgtgcngaatgggccagaggccacacgctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413825 - DNA, 1743 bp, Homo sapiens
  misc_feature (1734)..(1734): n is a, c, g, or t
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtttaaaaaaaaacaaaaaaacaaaaacanaacaaaaca

SEQ ID NO: 413826 - DNA, 1670 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413827 - DNA, 1421 bp, Homo sapiens
aaatgtttaaaaaaaattagccagacatgatggtgtgtgcctgtagtctcagttattcaggaggctgaggcgggaggagcacttgaatccaggagattgaggctgcactgagccatgatgcagtggcacgatcttggctcactgcaacctccaccgccccgattcaagccattcttctgcctcagcctcccgagtagctgggatcacaggcgccagccaccatgcccagctaatttttggtatttttagtagaagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413828 - DNA, 1100 bp, Homo sapiens
gatgggtttggcactcttcatttctcgggattacacgcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413829 - DNA, 1547 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413830 - DNA, 1642 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413831 - DNA, 1618 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413832 - DNA, 1592 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413833 - DNA, 1318 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaagtgcggctgggatccggcggccacctgcacctgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgtt

SEQ ID NO: 413834 - DNA, 1167 bp, Homo sapiens
gcacagccatgcccaggccaggacccgtgacacagcgatgctctcagatgctgctgatgttacagatgttgttgggggcaccctgagggggcaccctgactctgcaggtgagaaccttctggggttcctaggaccctcggacaagcactctgatccggatgactccaggtcccaggagttgcagaaacgccaccaggaccttcagagcaccagttagacaaggagagccaggaggagctgggccccaacctcatccaaaagcacagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaa

SEQ ID NO: 413835 - DNA, 630 bp, Homo sapiens
acttgttaggggaggaggagagtattttccccatctctgtgccctccatggaggctccaggggtgcagggcactggatgaggtctgggctgtggtgggacccaggagggggcaggcagaggggcacactcttagcccgccctaaacccatctgtgccgtgtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacacctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcgggaggagcacttgaatccaggagattgaggctgcactgagccatgagtgccccactgcactccagcctgggtaacagcaagaccataataaataaataaataagtgaagcaagtaagtttttgactg

SEQ ID NO: 413836 - DNA, 449 bp, Homo sapiens
cttcctttccttcttccatcccttcttccatctttccagctgtcaaatccaatccagtctctaacctagatgcagatcatttatttaaaagtaccaaacataacccagagtttgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagacta

SEQ ID NO: 413837 - DNA, 3426 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413838 - DNA, 3388 bp, Homo sapiens
tatgcctcataagtcatctgcaactttaaatggtagctctcccaggttcaagcaattctcctgcctcagcctcccaagtagctgtgggcctgcgcactacagctctcctgccttttccctgcatgccggaggcctcctctccctgttctgatggctggctgtggattctcttttacttctaggactctaatccctttgcttcccttgtcttctactgggagccacttaaccgtcaggtgagtgaattttcccaggacagcctgggatgggctgggttggcagggcctgagtttatggctacgtctagcgaaggtccccagactgggcaaacatcccagctgggcactctgcctctaaaatagccctcagttagttggagccaagagtggtggggcagccgatcgaacagagaggaacggggcctgtgctggtagggagggcaggtggcatttaatgccattcacccagagccatccctgagcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413839 - DNA, 3301 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413840 - DNA, 3422 bp, Homo sapiens
  misc_feature (3352)..(3352): n is a, c, g, or t
  misc_feature (3362)..(3362): n is a, c, g, or t
  misc_feature (3378)..(3378): n is a, c, g, or t
  misc_feature (3382)..(3382): n is a, c, g, or t
  misc_feature (3385)..(3385): n is a, c, g, or t
  misc_feature (3388)..(3389): n is a, c, g, or t
  misc_feature (3405)..(3405): n is a, c, g, or t
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagagattcagntttccggaanatttgagacccagggnttcnacnctnntgtgataaaagcattnagagccgtgaactttaa

SEQ ID NO: 413841 - DNA, 1344 bp, Homo sapiens
cggacgcgtgggtcgacccacgcgtccggggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413842 - DNA, 2894 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactaaaaaaaaaaaaaaaaaaaaaaaaaaaaaaaaaaaaaaaaaaaaaaagggggggggggaaaaatttccccgggggggcccataagggcgcgcttacccgagcgtttttttattagaaaagggggcgcccccataataagaggagagcgcgtgagtaataatacaaccgcagagcggcagcggggcgcggcggttttaacacaaggcgcgtgggagcgggggagacacccgggctagcacgccgggaggatccttgggaggaggaggacccatatacttctcggggggggggcgaccaaattgcggcggcaaacactatccctaacagaagagaattataaacggccccaaggggagaaattattcaatacttcacgcggtgtttctggggtgtaacacccaccgccggcaaatttctctcgcgcgttgagaaaagttggggcacacgggagttagcttttatgacaatttttccgcgttgtgttataatatagagc

SEQ ID NO: 413843 - DNA, 1323 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagacta

SEQ ID NO: 413844 - DNA, 320 bp, Homo sapiens
cccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggtgccgccgctagggccaggcctcctgcaggggcgggggaaaaggggtccccggagtcatctacagcggggaggggagtagtaggagccc

SEQ ID NO: 413845 - DNA, 2399 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagacta

SEQ ID NO: 413846 - DNA, 3552 bp, Homo sapiens
ttcaatgaatgaatccaaaatgagtaaacctccctgagtccatgccagccaagcatgcatttctcaagactcacaaatctgtgggtgagagaaatcacccagtctcactttggagtccgactggcttaaacttagctccaccacttcctgcaggaacttgggcacgtgacttagcctgtctctgtgtctgtgacaataggcctacttttgagggtttaaatgagctcttacggtgggtgcatctgctgtgggcctgcgcactacagctctcctgccttttccctgcatgccggaggcctcctctccctgttctgatggctggctgtggattctcttttacttctaggactctaatccctttgcttcccttgtcttctactgggagccacttaaccgtcaggtgagtgaattttcccaggacagcctgggatgggctgggttggcagggcctgagtttatggctacgtctagcgaaggtccccagactgggcaaacatcccagctgggcactctgcctctaaaatagccctcagttagttggagccaagagtggtggggcagccgatcgaacagagaggaacggggcctgtgctggtagggagggcaggtggcatttaatgccattcacccagagccatccctgagcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413847 - DNA, 3720 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagcatttgaggagagctcatcgtgaccgtcgcctgtggaccccgagctgcaaaaaccgaggtttttggccttgggcccctggggtttttcttgaacgggaggggccttggttcaagtggttccctgaacactaggggaacgccgaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgagtgaattttcccaggacagcctgggatgggctgggttggcagggcctgagtttatggctacgtctagcgaaggtccccagactgggcaaacatcccagctgggcactctgcctctaaaatagccctcagttagttggagccaagagtggtggggcagccgatcgaacagagaggaacggggcctgtgctggtagggagggcaggtggcatttaatgccattcacccagagccatccctgagcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagactactcacgtatctgcttttcttactccccacctctgctgataattcctagttcattggtttttcccccacactggaattacctggggagcttaaaaaaccctgatgcctgggtcccaccctcagagatgattgaaccagcctggccagcatggcaaaaccctgtctctactatgatatgaatgcagcctgggcactgggaaatttaaaaactccccagataattctgtgcagccaaggttgagacctcctagtctagagctttgctatacacagggtggtccacaagccaggagcatcagcatcacttggcagcgccttagagattcagaccccagacccactgaatctgaccctgcattttcactagaccccaggtgatcagctgcactagactcaacctctaaaccaagacctcccaccctcacagtctatgatcctttagtgaccctcagctgagtcctgtgctgaactgtgtttgttctccttgagcacatgcccgctgaccagggacagactggatgagcaagcaacctgctggctatggagaagagccaggctgggtaaatgtttgctgtgactaagccaggatcaaagaactgcctgttgcttgcactggctggcactgagcttgccactctgtgaactgtgcttccttcccctgcatggacctgtgcctcagtcactattatccgcaggccttctccaagggcagccctctccttgtttatccctcttaagcctgcgtgcaggaaggcacattaaccctgtggccccctgcaggcaggagggtgttgggtgcccttacctaccttgccctttttcttgtaccgtaggctgtgccgtttatgagtaagtgatgtgtgtctgtgtgtgtgtctagaagtgctgcactcaccttgtgttattggaggttgtgtaaccccctagctttgagcctggtctcagatgttccttttccgttctctgtccagccgttaccgcccccagtctgtaataaaagcctatcagccgtgcactttaaaaaaaat

SEQ ID NO: 413848 - DNA, 2151 bp, Homo sapiens
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctcttctttttttttttttacttaatctagctagaatctatttctgttgattacaacttaactaactcatttacggataggactttttttttttctttttttcttttttcttttcttttttttttttgagatggagtctcactctgtcacccaggctggagtgcagtggtgtgatcttggctcactgcaacctctgcctcccaggttcaagcaattctcctgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagacta

SEQ ID NO: 413849 - DNA, 2086 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggacccccca

SEQ ID NO: 413850 - DNA, 4395 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgtttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413851 - DNA, 3199 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatcc

SEQ ID NO: 413852 - DNA, 4114 bp, Homo sapiens
gggaaggaggatttttaaagttcctttccaaaaacacggggctcaggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413853 - DNA, 4394 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataagatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413854 - DNA, 3118 bp, Homo sapiens
gtaattaatatttgctgcgagttttttaactgtgtactattagtctgtagtattcggttatgattgacgggatttgttaacccacgtaaacttatatatgttagcgttctgatataagtcacgtgtgtgagagagtatacattcagagctctttagcacaggtcgtacatcagatttagattgtaaacatgtcacctagaaaatggtttttttgtgtgtgttatgattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413855 - DNA, 1385 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggtctgggagaactgatcttgctgaaaatacaacaggaagcagtatcgtgccaggcaaggcaaaccctcgtcagtgtgaagcaatggccatcgttgcagcccaagtcatggggttttgtgtggcagtaaccgttggaggcggcaatggccattttgagttggatgttttcaagccaatgatgattaaaaatttatgttacactcaggctgctgggggatgcttcagtttccttcacagaaaactaaatagtgggaatccggaccaataaagaaaggatcaagaagctaatgaattagtcgctaatgctggtgacagctctcaaccctcatatagggtatgacaaaacagcagaattgctaagacaacaccccaaaatggatcaaccttaaaggaaactgccgttgaacttggctctctcacagcagagcagtttgatgaatgggtaaaacctaaggacatgctgggtccaaagtgacttaaataagttttaatgaaaataaacgtgtaaaatt

SEQ ID NO: 413856 - DNA, 4449 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413857 - DNA, 3038 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatcc

SEQ ID NO: 413858 - DNA, 3628 bp, Homo sapiens
tagctggtaccagatatgcagagaacccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413859 - DNA, 3700 bp, Homo sapiens
tgcgcaggcccgcaaaagagggacgggggtggtgcctttggggcgcggcgccgggattgggagggcttcttgcaggctgctgggctggggctaagggctgctcagtttccttcagcggggcactgggaagcgccatggcactgcagggcatctcggtcatggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactgacaagggtcaggtcattgatgcaaatatggtggaaggaacagcatatttaagttcttttctgtggaaaactcagaaatcgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggccatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaagatatcaatttatttacattttgacaaactctatgtaataaggctttattacctcacggccatgtgtgtgatcatgtgtaatagcatgtgtgtatgagagagagaagccatatgtaattatgtgtaataacgtctgtgagagagaagccatgtgtgtgatcatgtaaaataacgtgtgtgagagaagccatgtgtgtgatcgtgtaaaataacgtgtgtgagaagccgtgtgtgatgtgt

SEQ ID NO: 413860 - DNA, 350 bp, Homo sapiens
catgggtccatagaaatactgaaaataacaattggggtcagggagaaggggaagctctacagaggaatgccaactaataaatgtaaaggccatgaattaaaaggctagacttagaatgtcaccattttatacccagtacattgattattgttccaggcaaggactatcaataaatgctgaggttaattggtagaattaacatgctacagattacttatcaattgcaaaggaaaaggtacctttttgatggccggaatctggcagccatcatcatcaccacgtgctccaacttaatatcaccaaaagtgggacagacttgcacctcctgaggtaattccctgagaaggaca

SEQ ID NO: 413861 - DNA, 1141 bp, Homo sapiens
cgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttggtatgattttacctgtgtttttgaatgttagaataaatcttaaagaacc

SEQ ID NO: 413862 - DNA, 4406 bp, Homo sapiens
cgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttcca

SEQ ID NO: 413863 - DNA, 1591 bp, Homo sapiens
gaggtcctggcggctgattctagagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtcaggtaagtgtaaatggccttctgagcatgctcttctaggctgactcccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacattaaaaaaaaaa

SEQ ID NO: 413864 - DNA, 450 bp, Homo sapiens
tacatttttctgctttttgtatatctttaaatatatatacactatggcttatatatcttaaggtgttgtttttaatttcaacaaaggcagggaaaggaattcttcgaacaatacgtgcctccaacaatgcccttgcagatcttgttcctgtagatgtagttgtcaacatgagtcttgcggcagcctggtattccggagttaataggtatatgaggtgacaatgtcgcttattaaatatatagtaactgaaaagggaagacatagcttttgagtaatgttaattaatccctctatccagatattgccataccaatatttaggctgtatcactgccaactccaagagttggtattatcacagacaatagcaagtgctcccatcagtagtaatgaagaattaatgttaatgctcatgtattacttacaggatagacaagttcacttaaaaatg

SEQ ID NO: 413865 - DNA, 438 bp, Homo sapiens
agtttttagaagacagctaccaagtatatatttggggttgtagagttcaaataataaatctctagcttcataatgtttctaagcttctctcccttttaaaatttttggtattagggatggattgataactttaatggaccaagtggtctctttattgcggtaagtaaaccttttgatttatttaatattctatacatttttctgctttttgtatatctttaaatatatatacactatggcttatatatcttaaggtgttgtttttaatttcaacaaaggcagggaaaggaattcttcgaacaatacgtgcctccaacaatgcccttgcagatcttgttcctgtagatgtagttgtcaacatgagtcttgcggcagcctggtattccggagttaataggtatatgaggtgacaatgtcgcttattaaatatatagtaac

SEQ ID NO: 413866 - DNA, 511 bp, Homo sapiens
ctagaaattcaaggtacatatctgttttacctacagtatacttaatgcctatcataagtttcaaattaatatggatttgagctttgattaaaaactcagtattaattagctgccatctaacaatatttttttctagaaaatactgtctaacatatctcttgatttgctttccaggttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaactt

SEQ ID NO: 413867 - DNA, 5264 bp, Homo sapiens
cgtccgctcttcagcagccggtcgcgggcggtggaaaagcgagtgaagagagcgcgacggcggcggcggcggcggcgcagctattgctggacggccagtgggagagcgaggcctgagcctctgcgtctaggatcaaaatggtttcaatcccagaatactatgaaggcaagaacgtcctcctcacaggagctaccggttttctagggaaggtgcttctggaaaagttgctgaggtcttgtcctaaggtgaattcagtatatgttttggtgaggcagaaagctggacagacaccacaagagcgagtggaagaagtccttagtggcaagctttttgacagattgagagatgaaaatccagattttagagagaaaattatagcaatcaacagcgaactcacccaacctaaactggctctcagtgaagaagataaagaggtgatcatagattctaccaatattatattccactgtgcagctacagtaaggtttaatgaaaatttaagagatgctgttcagttaaatgtgattgcaacgcgacagcttattctccttgcacaacaaatgaagaatctggaagtgttcatgcatgtatcaacagcatatgcctactgtaatcgcaagcatattgatgaagtagtctatccaccacctgtggatcccaagaagctgattgattctttagagtggatggatgatggcctagtaaatgatatcacgccaaaattgataggagacagacctaatacatacatatacacaaaagcattggcagaatatgttgtacaacaagaaggagcaaaactaaatgtggcaattgtaaggccatcgattgttggtgccagttggaaagaaccttttccaggatggattgataactttaatggaccaagtggtctctttattgcggcagggaaaggaattcttcgaacaatacgtgcctccaacaatgcccttgcagatcttgttcctgtagatgtagttgtcaacatgagtcttgcggcagcctggtattccggagttaatagaccaagaaacatcatggtgtataattgtacaacaggcagcactaatcctttccactggggtgaagttgagtaccatgtaatttccactttcaagaggaatcctctcgaacaggccttcagacggcccaatgtaaatctaacctccaatcatcttttatatcattactggattgctgtaagccataaggccccagcattcctgtatgatatctacctcaggatgactggaagaagcccaaggatgatgaaaacaataactcgtcttcacaaagctatggtgtttcttgaatatttcacaagtaattcttgggtttggaatactgagaatgtcaatatgttaatgaatcaactaaaccctgaagataaaaagaccttcaatattgatgtacggcagttacattgggcagaatatatagagaactactgcttgggaactaagaagtacgtattgaatgaagaaatgtctggcctccctgcagccagaaaacatctgaacaagttgcggaatatacgttatggttttaatactatccttgtgatcctcatctggcgcatttttattgcaagatcacaaatggcaagaaatatctggtactttgtggttagtctgtgttacaagtttttgtcatacttccgagcatccagcactatgagatactgaagaccaaggattcagcattagaacatctatacatatggtgatctaaatgtacaaaatgtaaaatgtataagtcatctcactttttgtcaagacattaaaccatcttagatcggagtgtgaagtaaattatggtatattttatgtaacattttaatgtttatgctcataaaacttagtgaacacactgtgttatgccagctcaaatctacagtagccaccaaaaccatgacttaatattttgagccctagaagaaaggggtgtgctgaggacaagagtggggaaataggaacactgaccagtataactgtgcaattctggaacatattaattaaaataatatgccttaacatatagtgaatttctaattctaatgttcagtgcaatggaagacatttatttggacagtaatactagcaaagttggtagatatttgattcttcattttttgtttttttcattagttgaagtgggttttagttttgtttaaaattataaccagcgtattttcacatcattctgtaagttaaatgatatcaaacatgaaagagatgttctcatttttctttttctgattaaacgtctgatgcatatcatttttctataagtaatcagttgcttttaaaatcagaaggctatattattctaatgaccctattcgatctaaatgggtttgagaatccatatcagcaacatacgtgttttttgacagaaagtgaaaacaaattccgtaaaactgttagtatcaaaaagaataggaatacagttttcttttccacattatgatcaaataaaaatcttgtgagattgtttatgttttgaagcaggaggatttcttgagatttgatggaagtgggagttgggaaggattcaccatacttgtgttctcctccctttataaattttattcataggacttttaaaaggcttgtgctatctttccagtgaaaactgaaagtgcattattatggaagaatgtatttgcaggtagtaatagcattaaaaaatatactcgtgtgtaaacacatactaattttgaccttgaaagatgaattccttcaagaaaaataaaataatgcttaagataatgtgtacgaaattaaataaaggactttatttacatactacataaggtagcaaactgttgaatgagtttgaaggtatcacttattttttatgcatgtgattttagctttagaaagaaatgcgttatagaaacaagtaatagcaagaaaattgatgtatattttaatgatacattaaaattcccttttaatcataatagttaactctacttactgttttaacatacatttgatttaacaaattgttcagcataacacttctaattaagtttatcaagttgtactgtattagataatcagcagtgtatctggagtatgtttaaagagaacagttcgcaatacaaaaagttacatggagctttacatcttaactttctttgtcaatttaaatgcaatgtataaaaagtttattttgctattgtgaaaaactaaatgtaaaggaaatcacctactttcatgcaggtgtataatcttgaaaaggaaaaatgcttccatgttgaagccagattttctgtagtaaaacttttaaatattattttaaaagaaatatgtatataaatatctctatattctttggaatgatactaaagtctctggtctaggaccataccttatataaaggtataagagaccatgacaatgtctgaaaatggaatagataatgatgccttttatttaaagtggcccacataatatacattgagtactccatctctccaaatgtatttccataatgtgttgaaaacatgctaacatttgtatgatttttatacttctgccgaatagacttagaatcagatgaattgtctgtgtgtcttgcaaaagagttggggacaacttgggcaggcctatgaagtgcatagggagtgtatgtcttctgaatggttttattgttcttgtaatctagcttaaagaaatgttaactgggagggtgctgaggccactcactgcattaattttgtgtgtttagagttctgttgtcaaaagaaaactaatgaataaattagtttgtcattctagaatttaaagttctaagattagtataaagagtatatagattgttaatccccaccagctagactttgaacttaagtcagacttaaagatttgagaaattatttgtgtcatttactagacgtgatttttagttctgtttgattatatttcctacacaaacttcttatttaacaggatagcctactaaattaaatgtttcttatttcacttaactcatttgattaaactgtattctaaaacatttggggtttttccccctattcagttttaatcttggaatatgcatttgtaaattgtgatgtcattgagactatatttatatttgacttggcaacattaacatgtcctaagacttagtgcagagaagcttggcagtacgttctttgacttaaggatggcataaaataatcatttttgaacctgtgtaataaagcttgaaagcagggaaaagaatttccttttcccccttttttgtgttgtctataggaattaacttgggattgttttgtgggtttttgtttgttttaaatgtaaattgagaatcttttataagaaataaaagcattattgggtgcctttgtttgtaaaccaaaaagtaataaatgaatccctatatttccattatagtatttattgtatttttatgttctgaaaattacccatggaacaatatgcttaggattacaggaagcagtccttacttacacttcttgtctgttttaggtgtacttgttaattcttatgtcctaattttatttaattctgagttccttacacagcattttagggaaagaatacaggcaggatgacactttgtgttaaagtgttatttttatgtattacctggaatgaggcaggtttttttctgttttctaaaaagagtaaccaagatacctccagggtgtcattgggttccagctgctctcctccacattgaatgatatcttgttaatttataggcacatttgtggtaatttatatgtctatagagtaagtataagagataattcattagtaataggaattaactgaccccttttggatgggggagagcatcaggctggggtcaggtaagtgtaaatggccttctgagcatgctcttctaggctgactcccagccctgacttgaaaccattagcgctaacttgctctgttttgagaaaaactttccaaacttttgcatgagaaactagaaaaaggaatgtatgccacgtaactggattacagaaatgagttaattgtctctgtgataaaaaaaaaaatgaaatattttcttattgaattaatatttttgtcttgaagcattttctagtgatagaatgtatttgtcttttttcctggtggtaccctcttagcatatatctttgctatccttaagatcctaaacaaatcatctttgtcagttaagtatagttgcgcaaaaattgttaaatcctttgtctttattaaagaaaaatttgagtaacattaaaaaaaaaa

SEQ ID NO: 413868 - DNA, 497 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413869 - DNA, 605 bp, Homo sapiens
ggccaagtcccccttaaaaggcaggttaataaattcccggcctacccaaatggtatcatttaaaatccaaacaataaaatagtcttcaaaaatgaaaataaaaaattaagctaaaaaagtccagaaattaatgaatttactcttttttcgtgccgaattcggcacgagagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413870 - DNA, 469 bp, Homo sapiens
cggacgcgtgggtcgacccacgcgtccgctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413871 - DNA, 679 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaatcattattgcccccctcggctgatcttcattttgcatgtcgggccgccttgccccagccgaattttagaatcgcacaagcttatgcatgccgccccaaattcgagcctactttggcccattcccccttattgggaggagattacaattcactggccgcgcttttacaacgccggggcgtgga

SEQ ID NO: 413872 - DNA, 852 bp, Homo sapiens
cggacgcgtgggtcgacccacgcgtccgctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaaaaaaaaaaaaaaaaaaaaaaaaaaaaaaaaaaaaaaaaaaaaaaaaaaaaaagggggggggggagaagcaactacgctcgctagaggaggcgccggaataattgcgagaagcacgacgaagcgatagttatgagaaaagagagggggagcgcgccaaaagagaggagggactaataatataagaaacacgagcgaggcgaggcgcaaaaaaaaacaacacgggagagggggaagaacagacgaaacaaagaggaacagtaaaaggaaaaagaccaccacatcaaaacgaagcgggaggggcgaaaacaaaggagagggcgaaaaaaacaacaaaaaaaagaaataaaagacaccacaccgcagcggagg

SEQ ID NO: 413873 - DNA, 395 bp, Homo sapiens
cgacggcttcaacggaacttttccagtggcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413874 - DNA, 451 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatccccccaagggcccccttttgggggcggggcccttttggggggcttttttaaaaaaaaaaattttttaaaaaaaccgaattgtttaa

SEQ ID NO: 413875 - DNA, 701 bp, Homo sapiens
cagatgttgaacaaatgtttgatcagaggagcttttggaggtgaaatgttccttagtgatacagagaatataaaatactctggcagttacttaggtagttgtggttgagggaatcagtgtattgagtgggtagtatagaaatgtgaagtataaatttgaattaaataaaatttaaaaattcatttccttggtgatactagtcatattccaggtggctagtagccacatgtagctagtgactactgtttttaacagtgaagatctagaacatttccttcagctcaagaagttctattgaacaacaggactgctctagaaaattaggacagcaatcaggtttggcctatatggagggtattagatcccaggtgagtttctgtgtatttttaacctatagaacagaatatctgtcattttcaagaaatagtctccgagagagtgtactctggtttaaacacgtaactgacagcattttaattcttacaggtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413876 - DNA, 501 bp, Homo sapiens
  misc_feature (33)..(33): n is a, c, g, or t
  misc_feature (63)..(63): n is a, c, g, or t
  misc_feature (70)..(70): n is a, c, g, or t
gtgctactgattgtttcattgcgaatctttttnagcataaaattttctactctttttgttttntgtgttntgttctttaaagtcaggtccaatttgtaaaaacaggactgctctagaaaattaggacagcaatcaggtttggcctatatggagggtattagatcccaggtgagtttctgtgtatttttaacctatagaacagaatatctgtcattttcaagaaatagtctccgagagagtgtactctggtttaaacacgtaactgacagcattttaattcttacaggtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413877 - DNA, 985 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaaggtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaaacttttttgggcgcgcgccttgggccctctgaagaaaaacgtttttaaacaccacttctgttggggcgcgcgcggggccccagttgggttagggaaccttgggccaaaaagcgcgtggtccccaagggaaagaccccgggcgccaggagacaaagcgggctgggtgttttctcccccaataaaaaaagcgcccgggggggcagcaccaagaggggttcctggaccaaattcccaaagggggagtcccagaggaggggaccaaaaacgcggcgctcctaacacccacgggggggcgtccaccaaaaggggagagaggctcgatgattttccaaagaaatttaagccgccgcagcccgctcgggggggtggtatacaccacgagacacagagatggagaactaagaagaacagcaagaagacaagtaaagacagccacaaaaagagacaacacgagagagctagcgaaccaagagaacacaggacgcggaaagacataaaaataaacaacgaacaacgaaccggacgaagaaagcggcgagaaagaaacaaaaacaaggaagagaaaagaggaggagaaaaaaagaaaagagacgaaagag

SEQ ID NO: 413878 - DNA, 503 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaaggtgagcaaaaattatgacaaatcatttacaacaaccttatatcaatgtgtcctcgcggcctctcgtgtgctttccttttacgaacatctcggccttctaatcttgaatgctgtctgtctcccatctcgtcccaagtcattgggatgatgtccttagcattggctttatcacccagtatttctgtttcggtttccagctctctttctgttatcggagtgatagtctagccctgctttttaattcttcagtaacctttgatttcagggaaggacattcttggtagacacctcgttccttaagtgatgtcctacattttagctttggggatatgtttactcctaaccct

SEQ ID NO: 413879 - DNA, 880 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaaaaaaaaaaaaaaaaaaaaaaaaaaaaaaaaaaaaaaaaaaaaaaaaaaaaaagggggggggggagaagcaactacgctcgctagaggaggcgccggaataattgcgagaagcacgacgaagcgatagttatgagaaaagagagggggagcgcgccaaaagagaggagggactaataatataagaaacacgagcgaggcgaggcgcaaaaaaaaacaacacgggagagggggaagaacagacgaaacaaagaggaacagtaaaaggaaaaagaccaccacatcaaaacgaagcgggaggggcgaaaacaaaggagagggcgaaaaaaacaacaaaaaaaagaaataaaagacaccacaccgcagcggagg

SEQ ID NO: 413880 - DNA, 594 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaacttaccaccgccaccctggcatcccccgccaccgcatccctctctctcgcccctatttcccttacccctgtcctgccttccctggtcacctgctttt

SEQ ID NO: 413881 - DNA, 520 bp, Homo sapiens
  misc_feature (498)..(498): n is a, c, g, or t
  misc_feature (503)..(503): n is a, c, g, or t
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaancccgngaatttagtagtagtag

SEQ ID NO: 413882 - DNA, 731 bp, Homo sapiens
ggccaagtcccccttaaaaggcaggttaataaattcccggcctacccaaatggtatcatttaaaatccaaacaataaaatagtcttcaaaaatgaaaataaaaaattaagctaaaaaagtccagaaattaatgaatttactcttttttcgtgccgaattcggcacgagagcgaattggcaccaaagcagcagctgtattgccgcagttctagcttcaccttcacgatgtttcccttggtcaaaagcgcactaaatcgtctccaagagggacagagaattgctctgttacccaggctggagtgtagtggtgtgatcatagctcactgcatcctctaactcctggactcaagtgatcgtccggccacagcctcctgagtagctgggactacagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413883 - DNA, 700 bp, Homo sapiens
ggccaagtcccccttaaaaggcaggttaataaattcccggcctacccaaatggtatcatttaaaatccaaacaataaaatagtcttcaaaaatgaaaataaaaaattaagctaaaaaagtccagaaattaatgaatttactcttttttcgtgccgaattcggcacgagagcgaattggcaccaaagcagcagctgtattgccgcagttctagcttcaccttcacgatgtttcccttggtcaaaagcgcactaaatcgtctccaagggacggggtctcactatgtttcacagactggtctgaaactcctggcctcaagcgatcctcctaccttggcctccgaaagtattgggattacagatttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413884 - DNA, 675 bp, Homo sapiens
ggccaagtcccccttaaaaggcaggttaataaattcccggcctacccaaatggtatcatttaaaatccaaacaataaaatagtcttcaaaaatgaaaataaaaaattaagctaaaaaagtccagaaattaatgaatttactcttttttcgtgccgaattcggcacgagagcgaattggcaccaaagcagcagctgtattgccgcagttctagcttcaccttcacgatgtttcccttggtcggagtgtagtggtgtgatcatagctcactgcatcctctaactcctggactcaagtgatcgtccggccacagcctcctgagtagctgggactacagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413885 - DNA, 444 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413886 - DNA, 698 bp, Homo sapiens
  misc_feature (676)..(676): n is a, c, g, or t
  misc_feature (681)..(681): n is a, c, g, or t
ggccaagtcccccttaaaaggcaggttaataaattcccggcctacccaaatggtatcatttaaaatccaaacaataaaatagtcttcaaaaatgaaaataaaaaattaagctaaaaaagtccagaaattaatgaatttactcttttttcgtgccgaattcggcacgagagcgaattggcaccaaagcagcagctgtattgccgcagttctagcttcaccttcacgatgtttcccttggtcggagtgtagtggtgtgatcatagctcactgcatcctctaactcctggactcaagtgatcgtccggccacagcctcctgagtagctgggactacagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaancccgngaatttagtagtagtag

SEQ ID NO: 413887 - DNA, 410 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtaagtactattgattaataatttctgtttcagatgtttttcattctcagtctatgcattcaaagtgtcttaacatagtagtgtacatatctagttaggagggacttgagagattgtgtaatctaatt

SEQ ID NO: 413888 - DNA, 535 bp, Homo sapiens
aagtattagttaatgttaccaaaatctgtattaaataatgttttcaaatgctaaaaaaaaaaaaaaaaaaaaaaacctcgtgccgaattcggcacgagagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaa

SEQ ID NO: 413889 - DNA, 1177 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaaaaaaaaaaaaaaaaaaaaaaaacaaaggggggggagcgccaaaaaacaccccacagggggggccacaaaaagaggagcccccgcaccgtagccacaaaggggggcccacaaagaagacacgcgacaattaaaacccagacatcagctgccaccgagtaaaaaccacgcacacaggagcaacagcgcaccacgaagaccaaccggaaaaggaacaccatcacaggggggacgcacccaacggggggaaaacgacaccacaagggagaacttacaacccgccccgcacgaaccaaataaaagcaacagcagggcacaaacggggacaacacagccgcgcataccgccggcccacacaagtagcgcaacaacgcaaaagttaggagccatccacgggggcgacaaccagacaccagagctacgacaagacgcacgcgaggcgcaggaacagaacagccgagcaccaacagaccaacgccggacagaggagacagcagcaagagaacaacgagcgccaaaccacgccgaagcagacagacccacaggcacaaacaggcaggagaaccaggcaaccacacagacaccagagcgaccaaagcacgcgacgacaggagaaggaggagaaagacgcgaacacgagacagcgacacacacacaaaacagattgga

SEQ ID NO: 413890 - DNA, 892 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaattttgggggggatgttcgagccatctggaaaacagtttctaaaaacacagtcgtgttgggcgcagggggcccacagaacgagcaacaaggtaaccatgtggcaaataagcgtgactacctagaggaaaactcgtgggtacaagagacaaaaagcggctggagatattcctccccacaacaaaaagagaaacgccgcccggggggtggaaacaaccacgaagcggaagtcgagggaaagcaaaaaccacgaaggaagggggagtatcacagaggaggaaaaagtaaaggggggacaccctatgcacagaggaggggagtaccacaaagaagcaaacgacggaaacactacgacaatttagcccgccccgagacgggggggac

SEQ ID NO: 413891 - DNA, 764 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaacaaaaagttgtcgcggccggcacagggcaccaacaaaaaggcttggaaaaccacctcgcttggggcaaatgcgaccccagtgagataacaacaccgggccacaaggcgtaccacgaggaccatcggcgccaccacgctggtggactcccacaaatgaaaactccgggaaaaccagcgggttcacaccacaccagtgagctgaacgcgctagcggttcaacaaagggctcaggaaggggataaataccccgcgg

SEQ ID NO: 413892 - DNA, 621 bp, Homo sapiens
gtcattacggatcccggctgaaagccattttgtttttcagctcacttcaagggtacctgaagcgaattggcaccaaagcagcagctgtattgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaaccttcaaaaaaaaaaaaaaaaaaaaaaaaaaaatttgttggggcggcttgggccctgaaaaagttttttaaaccattgcgtttgggcggcgggggccccagtgggttaggggcacggggccaggcggtcccgggggaaatgga

SEQ ID NO: 413893 - DNA, 402 bp, Homo sapiens
cttgtctacttgtgttgtagaaatcagccaagaaattagcttagttgaaatcagtaagtttggactgtaaaacaaagcttctaaataattattggtctaaaaactaaaaccttataatggaacagaagagtaaatcataaaaccaaagccctaacatttgggcttagcagcagaagtatagatctcttttaaaaatctcctactgatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtctgcagtccggcctgggcgacag

SEQ ID NO: 413894 - DNA, 359 bp, Homo sapiens
cagcagtgcggggccactggggtcccaccagaaaccagggcagctgggtgagggacggtctgggatgtgggaggtgcccttggctagcatggtcagtgatggcggtggggacagcgtgcctggttatgacagatctgctcctgagaacggcgctgcctctgcacatcgtgtagcagcttgggacaggcaaagcatttcccatttgtgatctcagtaaccgcagagcgtagtgaggtgggagaggcttgagaggtgagctgaccagcgcaggtcacacaacaggaagcagtagtgtgctttgcacttggcccccacactgtcctgaggttgaaaggtttaaatgactcgggcactgggga

SEQ ID NO: 413895 - DNA, 477 bp, Homo sapiens
ttgaaatgttctggttgatgttcagcatccagataaagcccacacttcccagcatgacctaagaacctgaccgtgtgactctgcttccctcttacagcttctccacacatgttccagcgtccaggcactctccactcctcgtgcctcccaccatgcccacctctcttgtccttcccatctttatgtgccacataacagcggctaagagtgccggcgtcagagctcataaggctttgattcaaaacccaactctatgacttaataattgtagagtcttgggtaaattactggatgtttctgagcctcagattcttcgtatacaaaaataaaccaccagcctcacaggattctcataaggattaactgtgatcatatttaaaatgtttagcacagtgcctagcccataattaagactgagtaaatattgctattgctatattgatgtatggaaagcccttggcacacagtagttgttta

SEQ ID NO: 413896 - DNA, 298 bp, Homo sapiens
ttccagttggctcaacccaggtaggctgtggacaattgatccaatttacccaatatttacccagcctcccaccccctttgctgggattctgccaagcaaactcaccaggaaactgaagggtgcttgtcagtaaatcaatttaattgttaattgtggccagacccaaaaatgttcatctaaaatcatagctgtcactctaaccctaaggataagagacatccacttaaaagacaaaatctaaaagtcccaaaggcaaattaatataaacgacacccgggattcctgagaaacggcaggt

SEQ ID NO: 413897 - DNA, 706 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413898 - DNA, 776 bp, Homo sapiens
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaataaaaaaaaacaaaaacacccgcaggcaccaaatctcggggcgcgccacaacacgccctgca

SEQ ID NO: 413899 - DNA, 352 bp, Homo sapiens
catgttggccaggctggtctcgaactcctgacctcaggtgatccgcccagcttggcctcccaaagtgctgagattacgggcatgagccactgcactcagccagaggctgcatttttagcacctgaaagatgtcacttatcattagtaagaatacatcaaaaataacattgaacttattttgtcttttccaaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413900 - DNA, 1579 bp, Homo sapiens
ggagctcggtaccattagctctagacggactgcaacctctcctcccacattcaagcgattctccttcctcagtctcctgagtagctgggattacaggcgcccaccaccacgcctggctaatttttgtatttttagtagagacggggtttcaccatgttggccaggctggtctcgaactcctgacctcaggtgatctgctcaccgtggcctcccaaagtgttgtgattataggcgtgagccaccacgactagccagattagggatttcagtagtgagcaaaactgccagataccctgttttgttttctctgattctgcgtcgtaccttccacagcattaaaccccctgacctgtaattgcagctcattccacatttgttgaatgaaatctggtcaataccctaatacctaaacattgagccgactaataccagagatacgtgaggtattgctctaacatggcacaggccagaagggctcatggtttggctggtggccatgaggcaagcctcgctggaagggaaacagattggaatgtagtgactgtaagctccctcatcccctctttgggtgggaggccagcttcctttgtcctggctgagatcagggagataactgctggaaccaaactagacctttctggtgtatggtcctcaatttgaattgcctttgggtttaccatgacagctctttccttttgggttattttgacttgggtcagcctattaaaggtggcagcaccctgtagaggcctcgggatgctgaagatgccatgagaagacacaggcattctgcagacgctagacaattttagtggcagttagtgtcgcagagcagtatgaatgtccagagcctgagggttgaagccaggaggcagaggggccggtcctgactcccaggaaggaggcctgagatgctgctgaactgttggggcttctgcgattacccagtcctgcaacttagtgtgtcctggtggccacaatgagaatcagatgctgtgggttctctaaagccccgaaagttctgtgaaagttacctataggcttgtgcattgatttagaggtattttccattcaatgacagtgtttccttcctgccgtcgctctaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413901 - DNA, 1639 bp, Homo sapiens
agattagggatttctttctttttcttttttttgagacggagtcttgctttgtcgcccaggctggaatgcaatggcgcaggctcggctcactgcaacctctcctcccacattcaagcgattctccttcctcagtctcctgagtagctgggattacaggcgcccaccaccacgcctggctaatttttgtatttttagtagagacggggtttcaccatgttggccaggctggtctcgaactcctgacctcaggtgatctgctcaccgtggcctcccaaagtgttgtgattataggcgtgagccaccacgactagccagattagggatttcagtagtgagcaaaactgccagataccctgttttgttttctctgattctgcgtcgtaccttccacagcattaaaccccctgacctgtaattgcagctcattccacatttgttgaatgaaatctggtcaataccctaatacctaaacattgagccgactaataccagagatacgtgaggtattgctctaacatggcacaggccagaagggctcatggtttggctggtggccatgaggcaagcctcgctggaagggaaacagattggaatgtagtgactgtaagctccctcatcccctctttgggtgggaggccagcttcctttgtcctggctgagatcagggagataactgctggaaccaaactagacctttctggtgtatggtcctcaatttgaattgcctttgggtttaccatgacagctctttccttttgggttattttgacttgggtcagcctattaaaggtggcagcaccctgtagaggcctcgggatgctgaagatgccatgagaagacacaggcattctgcagacgctagacaattttagtggcagttagtgtcgcagagcagtatgaatgtccagagcctgagggttgaagccaggaggcagaggggccggtcctgactcccaggaaggaggcctgagatgctgctgaactgttggggcttctgcgattacccagtcctgcaacttagtgtgtcctggtggccacaatgagaatcagatgctgtgggttctctaaagccccgaaagttctgtgaaagttacctataggcttgtgcattgatttagaggtattttccattcaatgacagtgtttccttcctgccgtcgctctaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413902 - DNA, 1417 bp, Homo sapiens
  misc_feature (731)..(731): n is a, c, g, or t
  misc_feature (734)..(734): n is a, c, g, or t
  misc_feature (736)..(736): n is a, c, g, or t
  misc_feature (740)..(740): n is a, c, g, or t
  misc_feature (745)..(745): n is a, c, g, or t
  misc_feature (748)..(748): n is a, c, g, or t
  misc_feature (751)..(751): n is a, c, g, or t
  misc_feature (755)..(755): n is a, c, g, or t
  misc_feature (759)..(759): n is a, c, g, or t
  misc_feature (766)..(767): n is a, c, g, or t
  misc_feature (769)..(769): n is a, c, g, or t
  misc_feature (772)..(772): n is a, c, g, or t
  misc_feature (777)..(777): n is a, c, g, or t
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaatcaaaaaaaaaaaaaanaananaaanaaaanaanaanaaanaaanaaaaaannanaanaaaanaaaaaaaaaaaagggcgcaccaccacaatgacatctccaccagacggcgccaaccacacaccaggacaccccgccaaccttctgtcacacgaaggcagcgccccaaacaagggacgacactaaatccaagacacaacgaggccgccccagtaatacccaaaccgcagagcatgcgaacacacacgctcaacagtgcactacacggagaaagaaccacccacgctggggcgcacaaccagatccaggaacaaccacgccaacggcgactaaccctgcccgggccgaacatacaaccaccacgcccgacacgcagcactacacccacaccggattgcgcaggggcagagacacaaacgagtccaccaagcatcactgacggaaccatcctacccacgcgacgaccgacaaacacacgaagcggacaacaagaagaacacacacgaccccacacccaccgcgcgctgccccacaccgcgacccacagacgacacgcgcagcacaacacgaaccaacagcccgaagacccgcgccgcacgcgccgccacgccagacccacgccaacacccacacagacgcccaacaacgggcccgcacgccccacacacacgcgcaccacacacagcccacccaaccaccagca

SEQ ID NO: 413903 - DNA, 767 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaataaaaaaaaacaaaaacacccgcaggcaccaaatctcggggcgcgccacaacacgccctgca

SEQ ID NO: 413904 - DNA, 997 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaataaaaaaaaaaagaaaaaaccgggggtcaattgtcgggtggggaaacgcggtatcggaatggcacttgttctagctgtttctgcccagtttttgtaccaacgggtaatctgccggtcccctaaaggagtcgattatttcgttaagcgtactgtagagcaccgagaagagaccacgcgtacccgccagaggctcaccattgacaaacggtcgcacagcatactgagccgtccccaaagatacatactcgatgacagtaacaacgccaacaaacacatcacccagagcacaaag

SEQ ID NO: 413905 - DNA, 718 bp, Homo sapiens
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcaggtaaatagacttaaaaaatgatgttcacccatagatttgtctgtggttcttcaataaaggaaacttaagaagaaacagaaaatggaaatgcttgaccaagatttttcactacttataaaatgcaagccctttcctgttgtctgccactcaaaggggcccagccct

SEQ ID NO: 413906 - DNA, 654 bp, Homo sapiens
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413907 - DNA, 824 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggtgactcgtggtgactttgctgccgcttggcaagggtcagggattgggcccggtgggggtgggggccgggcatccggggcgcgccagctgcaggcaggggtgacccggggggcagccggctcgctccgcagccccgctgcctaaaggtgtttagttgacccctgacgggaggccgggtgacctcgtaataacgagcaagagcactgactcgagtccagcactgctgggctgccgcttaccgaaactttggacaagtctcctagcctggctcacactcacctgcaaaattgggatcctggtctctaccttgcggagtagcaatgaggattagatgagttaatgcggctagagcacctcgtacggtatcaaaatagcggtcaccgtattgtagtgaaagcagcatgcaaagaggcagccacactggcctacagccttctccagagcggttttctctctgcagttctgtccttactcttccctgcagcaacttctgcctgtgtccaggactcctggaagtaattctaggaaacaagccaagtgacctttgaacaataaggattgaattgcgcggtccacttatatgcggatttt

SEQ ID NO: 413908 - DNA, 715 bp, Homo sapiens
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413909 - DNA, 889 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaattttcccccatcttcagtttttcaatgatgtctataaagtgcttttttatgtttgtatactgacattgcttaatatttttaaaggtctgatttgtcatttgtattcatgcatgtcaaaaacaatggcttccccagccatgtacttgaagtaaggctgtctccccaccttcgtatcaggagtgaa

SEQ ID NO: 413910 - DNA, 753 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaataaaaaaaaaaaaaacccggggatcatatgccgggcggaacagaggtt

SEQ ID NO: 413911 - DNA, 686 bp, Homo sapiens
tgcgcgccgccggaaaggaaccctggtccggctagtgcggcgggctgtgcatcctggcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcaggttcctggtagagttacacagttgtgccgccagtatagcgacatgcctcctttgacgttagagggcatccaggaccgtgttctttacgtattgaaactctatgacaagattgacccagagaagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagagccttcttcctcactgtgaggactccagaggacacacgatggcatcgtggccgactgacagcggctctgttcaacttgtatttaaattgtctgagtgttttacccgttaaaaataaatctattacaaaacta

SEQ ID NO: 413912 - DNA, 583 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaat

SEQ ID NO: 413913 - DNA, 816 bp, Homo sapiens
tgttcacagaagggcgaaaactaggctaggtacgaggcctgggtggtgcctgggttggcgtagccatggcgtctcgtgtcctttcagcctatgtcagccgcctgcccgcggcctttgcgccgctgccccgggtccggatgctggccgtggcccggcctctcagcaccgctctctgctccgcggggacccagacgaggctcgggactttgcagccggccttagtgctcgcgcagctttcagtaaattctcattttatgaaagacctgggcttagacagtttggaccaagtggagattatcatggccatggaagacgaatttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaaattgtatgtgttttactctttgaaaataaatctataaaaccaaataaacacaacacaagctacgaaaacagaacactcgcgcgggcccttctatttccgcgggtgcggccaaggagcgctactcgacaatggcgcacatgtgggccaacagcggtgtttcccctagcccccagctttcgttggctcaccaacaggggcaaaacatccgccgggttccccccttaatagtgcacttcgcaaacaaatccaaaaaacgccagtgtaaaccgtgcttcagg

SEQ ID NO: 413914 - DNA, 3808 bp, Homo sapiens
gtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctactaatttaaacgtgcatttttcacagttacacatttaagttttgctaccaaaaatggccatttttctagacagataacattttcctaaagtggaagagagatccactgttctaaaaaaaaaaaaaaaaaaaaaaaccctaaattggtgccttctcccttaatttataagaagagtaatagtaaaaacttgtttaaacatatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagctatttt

SEQ ID NO: 413915 - DNA, 3739 bp, Homo sapiens
gtctgtttttgtttatttgtttttaagacccaaaccttttcaatcttgcatttatttacttggttctcctgtgtcaccctgtggctttttaaatagggaatgtaatttattttaatagtagttctcaaagactctattaaaaactctggacgagggatatgtgcaatctgttggtaagtcacatcctatgtttggcctcatttttataactcctaaaatgagaaaggtagattttaacacttctaaggtacctttgagctttaaagttcttttctgcttttccatatgatttgtgttagtgttcactttttatatatttagagtttttatatgagtgtgaatgtttctgttttgatttggtgaggcatgtcagaggtatatacttgaatatttttctaaatacagctgctggaggaatgcaaatggcaaaaatcatccagaaaaccaaacacggtgaaacatcacatccatttggcatgaagcaaagcattacaaatttggagtgatgaaagtgttccatatattttttatagtgatttttcgatctagagacccttcatattgtttacttactattacgataactttgagaggtaaccagagaaagcatttttgccatttccagatgaggaagcaggaccagaaagctcttcataaagctttaacaccatacaagtatccagcagtgatcaattgctctttataggaaaccacctttcctctggggaagaacagtctgaattaataaaacatcagagtggttgagtagtaaaaataaacacagatgtattgctttcaagtcttagagtgacataaagtagtcttaaataaatagttcttagtttattttaagcagttgattgtactaacgagatgtaattatctgaagtatttatgattagcatattggtttttataagtatttctgagttattgagggtgcttaaaaatgctgaagaaactttaaaacatgattcttcttataattttatgtgattcttatagcacaatcatttttgaaaaaggaaaactaggctgggtgtagtggctcatgcctataatcccagcactttgggaggccaaagtgggtggatcacccgagttcaggagttcgagaccagtctggccaacatggtgaaacctcgtctctactaaaaataccaaaattatccggtgtggtgacaggctgcttgtaatcccagctactcgggaggctgaggcacgggaatctcttgaacctgggaggcagagattgcaataagccaagatcatgccactgcatgccagcctgggtgacagcacaagactgtctcaaaaaaaaacaaaaaaaggaaaaagaaaactagccccagtccctgtctaaattgttatagtttttgactattatctgaattagtcttatccaaatttcatatgcagattgatttttcattttgtatgtatattacatgatataactattttcatagaatatatttctaatttacaaacactgaattattagcttgatagagtttctcccaaaccttataaaactttgaaatgtacttatgtttgagctttaaaaattataaaaacttcatttaaacaagttgctggcatcattactagcctttccacctataattatgatgcatttgatgccactgaacagtaatagcacaaagaacaggtcacacagtctagactggattgagttttaattaaacttcttcatccatagcctgataagaatcaggctgggtctagaagagttatcagactgtaggcctgtattaattttgcaagctaatgttaatgtttactgccagccttgcatagcaatgccagtttgcagttgtgactatgatgtgacttttggtaaaaatggtttatatctaaagtagtttagattttatggaagtggctcttgattgtttggacaagcagggtaggtaaatttcaattacgtttgaagtgtaattaaatcctagaatagagcactctccagaaaaaaaaatgaaaaaagaatttggagaatatcctggcatgaaaacttttttgaataatacgtagaattttgacaaggttcatacagtgcatacagtgtgaccttttctgaggtgggcagggagggttgctacgttgtgttgatttaaaatttcaaggaggaacaaaaacattctagccaaggagaattgcattgttatttttttttctaacagataacattttcctaaagtggaagagagatccactgttctaaaaaaaaaaaaaaaaaaaaaaaccctaaattggtgccttctcccttaatttataagaagagtaatagtaaaaacttgtttaaacatatattttctttttttctaatccctctcagttctccttagatctgcctcctacaaatgatcatgttgtttgcatctgcctgattgagttcccttggtcaaacctctccctatcactatcagaagttgttcactaaatgtattttcctatttctttcatgttgattgactttataagtcaccttggtaaacataacatttggctaccttctcatgctttataaatgaatttgatgaatggcagtttttatattttaaccctttaaaaagtttgtcaaggaaacaactcagagctaagaacaaaatctaacttggaatcagtttcttcctttggctgctgaagcagcagcaagtcacgtaacctcatttagttttttgatttacaaaatgtggataataacctacctcacagatgtgtgtgagcaactgtttgaaagcccttgtttaaatacagggtttatatccccacattcaatgtaaattcctttttttaaaaaaaaataagtatctttgatactgataggatgagtatcttgatttttaggtaagatcacagtttcacaaattgtggtgttgttaggtgacatttaatatttcttgagacctcaagtattcaaatatcaaacttgtcctgtgttgtaacaaatattcagaatctcttaaaatgttggctgaagctgccttaatgtaccaaaatacagctctcaagactgttcacaaatatctgtggttgtacaatgttttgaacatttaatgtaaagttgttgtagaactgtgaactctaaggatagtatctttattgttttaggaagaatggttgtgttctttgtcatgtatgcttaaatatacagtggattttgaatgcaacaaataaaactgaaaacagccatttggttgtgtcatgacaatcataatataggatataatatttactttttttcaaaaacatcctgcattcattcattcttagcatacctttgaaaaagaaaaaaaaatccataggttgatacattgacccattgaagtacttcattacgtatttattgaaaattttttttaattgttgaaattgggaccactttttataattggtttcaagaaaaaaaaatgaacagacttccagtgcttttctgttcaaataaactccgattcaaatttcagttttgtttgttatatactttttgtgagtgttaaatgatatgggaaggatttgtctttcattaaccatatggaaaagatgtcttcctgaattacatagcatttcatagttacagattcttcctaattaatgtttgcaccatatgaaactcataggtaacaaacacaaaggagaaaagcagcctgtctgattgcttataagcttttttcacaaaatcaaattaaaagtctctgattcatttgaaagctatttt

SEQ ID NO: 413916 - DNA, 365 bp, Homo sapiens
ctaatcctcaatcctatcccttttcctcttagccatcctctctaatttgtttaacctaagcctgtgtgtcctcagaaaataggttatgctgttggtgtgtgtggttggtaatctatatacatggtgttatgctattgattttgtttggtaatctccctttttactcaatactatatttataagatccatttaagtggttgtatgcctctactttattgcttctgactgctgcatggtattccatactcatgtccaccacacttactcattctccctcttgatggacgctgaagttgcttgcctccaacaacctctactgcaaacattgcagcagcagacatccttatatatgcagccctaaaacc

SEQ ID NO: 413917 - DNA, 1035 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctcta

SEQ ID NO: 413918 - DNA, 412 bp, Homo sapiens
gagcaactggacacacgttagttctgtaacaaacgacagaggaatcttactggacacagccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctcta

SEQ ID NO: 413919 - DNA, 478 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtcgtcgtcgtcgtcgtcgttcattaaatcttgataatgcattactgagtcttttcaagggatacttttaattccccaatcttcaaccataaagaatatatagtgctaatctgccttgcactttcgattggggatcctctag

SEQ ID NO: 413920 - DNA, 3564 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccagacacctttccattaaaatctacttcaaatcacaagttgattacaattgagtggaacatcccatgttgtaaatggaataatgtgttcagaatgctctttctttcccccaataaagccctttatagtgtttgccccaggtgtaattc

SEQ ID NO: 413921 - DNA, 3162 bp, Homo sapiens
acctgagcagtgtttcctccacaggggtctcagtctgggctctaaagagctcctccaccaagtttctaaattttaataatttcagcctattgttcccccagagtagtaactgctttctggaactgaactctgtgataatgtagtatttactttttgccttttcaataacctagttaacaattttatacctactgagttctatttaaataatggtattttctatctcctgactggacagatacccaggagtagggtttgaacttcctactttctggtttgcatatatcttattaagataactaaagtacttgctacttgccagtcttcagacccggtcagtgtaatgtcatcagtgcagcagatcagtgtgatgtgtgatttctcaatgtgatcaaaatctctggactattttagagagcaagagtgttaacatagacctgaagcaagactgtaatggttgaacaaagcacaaagtgcttctgagattttttgcaaattaataggaagaaaaaagcatttgcttccaagttataagaattgtgttgatttgaccccgtaaaaatactacatcttgaatactagctgcaattacagtcacgacctttctgtgtttataattcatagctattctccaagatccatctgtcttatatttagatcaaacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413922 - DNA, 2888 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggacaagagcttggtcaagggtgccaccagccacaaaggtttctgcccagaaaagtgacatcccaaagatcccaaaatacaaatagatacttcctgtttatcatctatttggaaaccagctatacagttcatactggaaaggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413923 - DNA, 2864 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccggggtctcactgtgttgtctaggctgagtgcattggcactatcatggctcactgcagcctggaactcctgggctcagtgattcttccactttagcctcctgagtagctgagactacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413924 - DNA, 2122 bp, Homo sapiens
  misc_feature (25)..(25): n is a, c, g, or t
agagcggacaatcataaaaaaaaangttcaaaaatatggacatatcgctaggccagccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413925 - DNA, 2117 bp, Homo sapiens
cgactcctgtagcctacgatgcgcgtcaggctggcgcagtcacttggccagccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413926 - DNA, 2125 bp, Homo sapiens
gagcaactggacacacgttagttctgtaacaaacgacagaggaatcttactggacacagccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413927 - DNA, 1073 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagagtctctgaattggagatgatctgtggctgtaattcagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctcta

SEQ ID NO: 413928 - DNA, 762 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctgccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctcta

SEQ ID NO: 413929 - DNA, 474 bp, Homo sapiens
gagcaactggacacacgttagttctgtaacaaacgacagaggaatcttactggacacagccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctaagtttacaataaattaatatcggttcaataggattacatttatttcggcctatttggcctca

SEQ ID NO: 413930 - DNA, 2748 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413931 - DNA, 2630 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413932 - DNA, 2515 bp, Homo sapiens
tcggacactttgctatacagtagaaaactgacagaacactgtaaaccaactataatggaaaaaatcatttaaaaatatgtgatatgtagatacagtggaatattattcagccataaaaagaatgaggtaatgccacttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagca

SEQ ID NO: 413933 - DNA, 1142 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaattctcatggaggtagagcttttcttatactgtaaaatggtgaagtaaggagggccgactca

SEQ ID NO: 413934 - DNA, 1009 bp, Homo sapiens
agcgggccaggcgcacgcgcggagctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagagtctctgaattggagatgatctgtggctgtaattcaggtaacaaatattggaggcaaaatctcttcacatgtagtctcttccagtcctcaaatgttgagccgtgtatatttttttctaacagctttattgagatatattttccatactgtgttagtctgttctcatgctgctaataaagacatacctgatactgggtaatttataaag

SEQ ID NO: 413935 - DNA, 1604 bp, Homo sapiens
ggggcgcggcccagcgacacccatgggagcggccgccagggggagttggcgccggggaggggggcgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagtgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcaggtaggaaacctctcagaggcatgtcgatctga

SEQ ID NO: 413936 - DNA, 2137 bp, Homo sapiens
ggggcgcggcccagcgacacccatgggagcggccgccagggggagttggcgccggggaggggggcgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttttggcgccgctggcagccgcgcatctgggcgctcttcgaggacccgtactcgtcccgctacgcgcggtatgtggccttcgcttccctcttcttcatcctggtctccatcaccaccttctgcctggagacccacgagcgcttcaaccccatcgtgaacaagacggagatcgagaacgttcgcaatggcacgcaagtgcgctactaccgggaggccgagacggaggccttccttacctacatcgagggcgtctgtgtggtctggttcaccttcgagttcctcatgcgtgtcatcttctgccccaacaaggtagagttcatcaagaactcgctcaacatcattgactttgtggccatcctgcccttctacctggaggtggggctgagcggcctgtcctccaaggcagccaaggacgtgctgggcttcctgcgcgtcgtccgcttcgtgcgcatcttgcgcatctttaagctgacccgccactttgtgggcctgcgggtcctgggccacacgctccgagccagcaccaacgagttcctgctgctcatcatcttcctggccttgggcgtgctgatcttcgccaccatgatctactacgccgagaggataggggcacagcccaatgaccccagtgccagtgagcacacgcactttaagaacatccccatcggcttctggtgggccgtggtcaccatgacgaccctgggctatggagacatgtacccgcagacgtggtccggcatgctggtgggggctctgtgtgcgctggcgggcgtgctcaccatcgccatgcccgtgcccgtcatcgtgaacaatttcgggatgtattactccttagccatggctaagcagaaactaccaaagaaaaaaaagaagcatattccgcggccaccgcagctgggatctcccaattattgtaaatctgtcgtaaactctccacaccacagtactcagagtgacacatgtccgctggcccaggaagaaattttagaaattaacagagcagattccaaactgaatggggaggtggcgaaggccgcgctggcgaacgaagactgcccccacatagaccaggccctcactcccgatgagggcctgccctttacgcgctcgggcacccgcgagagatacggaccctgcttcctcttatcaaccggggagtacgcgtgcccacctggtggaggaatgagaaaggatctttgcaaagaaagccctgtcattgctaagtatatgccgacagaggctgtgagagtgacttgaccaggcggcttggccgaggacactggtggctattaagcatctgggtggacctgcagcccctcctcaccctcggacagagtaaattcacgccatgcaggtttgccggacgagtccgagtggcccaggcattgtactaggacggacgtagctttttctacggccaaatggtaactgaccgtagaggatttcttttccttcttttcattttttaaaattttattttatttggggagggggggtggaggggctccttagcatgacttgcatgaagttaaacagaaaacccagcaaaccaaacccaccaaccccct

SEQ ID NO: 413937 - DNA, 539 bp, Homo sapiens
gtcgctgggccgcgccatgcctaagggggggcgcgatgggccaaggggacgagagcgagcgcatcgtgatcaacgtgggcggcacgcgccaccagacgtaccgctcgaccctgcgcacgctgcccggcacgcggctcgcctggctggcggagcccgacgcccacagccacttcgactatgacccgcgtgctgacgagttcttcttcgaccgccaccccggcgtcttcgcgcacatcctgaactactaccgcacgggcaagctgcactgcccagccgacgtgtgcgggccgctctacgaggaggagctggccttctggggcatcgacgagaccgacgtggagccctgctgctggatgacgtaccgccagcaccgcgacgccgaggaggctctggacagcttcggcggcgctcctctggacaacagcgccgacgacgcggacgccgacggccctggcgactcgggcgacggcgaggacgagctggagatgaccaagcgcctggcgctcagtgactccccggatggccggcctggcggcttt

SEQ ID NO: 413938 - DNA, 323 bp, Homo sapiens
ctcttccatgcttctactcttccttcagagctcagttcaagtgtcatctttccctgatcttcatttttccacatctcagtgataggtgcttcttctatgaacttccagaaaaacctctcctcatcttgactctacagccactgtaccttattaataaattaaccaagcaggcaaatattgagtatttgttaggaactcaagtcttgggctcagctatgtggaagagaattatgaggcatgattaccaatttcagctttgcaagagaacacaatgcataagagaatttaaacattctctgaggagctcatttctaaattgtgtt

SEQ ID NO: 413939 - DNA, 294 bp, Homo sapiens
cagatggaggtgggggagagagataaggagagaggcagagaaggagagagagagttctggcaatgcaatgcctagttccaggcctcccgactctggtacctcagtcttgtgagctctccctgcagcctttaagggttaagccctttggagctgggtttgtgtccctggcgacagaaggcattttgactagggcagaaggtttcttgtcgacctcatgggaggccagacgtgcggggtatgcactggagagtgaggcaggcatggtcaaagagcttgtgcggcagctgtccctgg

SEQ ID NO: 413940 - DNA, 410 bp, Homo sapiens
acaggcgtgagccactgtgcccccacctatccccatttttcaaatgagatgactgaggttcaaagtagttcagtacctgccccaaagccacaaagcctgtgctactctgcccccaagaattagtgatttccaggctgtgcctggctctgctagctagcagctgtgtgaccttggcaagtccgtttgcctctctgagcctatctacctcctctgtataatgggtctggtagtcttcacctacctcaccagctgctgtggagctccgacgagatggtgactgtgaaagcacttgacaaactgaaggcactggacatgccttgtggtcagtgtggcctcaacccagatgtccagtgatttccagggcacaggggctttgagtgggatggccaaagaagacacctccatccaac

SEQ ID NO: 413941 - DNA, 215 bp, Homo sapiens
acctaccttcccacccatctttaagagagcagcttgcctcctgccactccctaccctagtattttggactccctttgtctcctctattttccttttacctaaagttcttgccacctcttaagacacgttactgtttttacttattgtgtgtattgtttcttgtcattttttgtttgtttgtttgtttgatgctgagctcagaataggtcatttag

SEQ ID NO: 413942 - DNA, 1282 bp, Homo sapiens
gacctagaatattgcatggtgcttgataaacattcagtaaatgttagttacaatcattattattatacgcatcatcgttaatattagttgccaaagcagctgagaaaagatggcttattctccaatcaggagagaggattcctgttctcggctacaggcactggactctttactggcattgcctttgagagaggctgtgatacaactcagtttctataccacatgctgccaattcctttttgatttaagaaatctctagcaaacatttagcactctccaagcatctttctttcatgcaccaggcacaagaatgaaaatgaaatcccagtgtcagctgactcaacagccctcatcttcatagtcccagaaacaccctaagtgctcccaggtccttccaagggcagtagtgtacctgcaccagcagtccctacccagaatctccctgttgaggctctcctgctcaggctgtgatgctggggcccctgagcccagcctgaggatgctggaaagggaccaatatgccctcttttgagaaggatactgcccatgcctaacactctgctttagatgcctcagagccatcctggtttcctcccagagtggtaagaaacacttttcatttattccagggattggtaaacttttcctgtcaaggcccagatagcaaatatttctggctttgtgggttatacagtcttaattgcagctactcaactctgcagttgtagcagaagcagctatagacagtatgtaacaaatgtgcgtgtttgtgttccaataaaactttatttataaaacagatggatggatagattaggcccaagggttgtagtttgtagacccctgatctagacccttaagtagccttgtttgtgcctgaagtttacagatgatccccaacttatttttattttatttttttgagatggagtctctctctggagcccaggttggagtacagtggcaagatcttggctcactgcaacctccacattccgggttcaagtaattctcccgcctcagcttcctgagtagctgggattacaggcgtgtgccaccatgcccagctaatttttgtattttgtatgttagccatgttggcaaggctggcctcaacctcctgacctcaagtgatctgcccacctcagcctcccaaagtgctgggattacaggagtgagccaccatgcccgaaccccaacttatgtttgacttacaatgtttggactttatgatggtgcaaatgttatatgcattcagtagaaactgtacttcaaattttga

SEQ ID NO: 413943 - DNA, 2877 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaaaacgggaagacaaagactaccttctattgtaatggactcaagttaaagtattactacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 413944 - DNA, 2768 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactttcatcaaaaccctgcagggccatgccttgaattccctcacggaaagcatgatggaaaacctccaacgtatcatgagacctccagtctcctctaactctttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaatacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 413945 - DNA, 2761 bp, Homo sapiens
gtggcatccttccctttctaatcagagattttcttcctcagagattttggcctagatttgcaaaatgatgaccacatctttgatttgggggattgctatagcagcatgctgttgtctatggcttattcttggaattaggagaaggcaaacgggtgaaccacctctagagaatggattaattccatacctgggctgtgctctgcaatttggtgccaatcctcttgagttcctcagagcaaatcaaaggaaacatggtcatgtttttacctgcaaactaatgggaaaatatgtccatttcatcacaaatcccttgtcataccataaggtgttgtgccacggaaaatattttgattggaaaaaatttcactttgctacttctgcgaaggcatttgggcacagaagcattgacccgatggatggaaataccactgaaaacataaacgacactccaacgtatcatgagacctccagtctcctctaactcaaagaccgctgcctgggtgacagaagggatgtattctttctgctaccgagtgatgtttgaagctgggtatttaactatctttggcagagatcttacaaggcgggacacacagaaagcacatattctaaacaatcttgacaacttcaagcaattcgacaaagtctttccagccctggtagcaggcctccccattcacatgttcaggactgcgcacaatgcccgggagaaactggcagagagcttgaggcacgagaacctccaaaagagggaaagcatctcagaactgatcagcctgcgcatgtttctcaatgacactttgtccacctttgatgatctggagaaggccaagacacacctcgtggtcctctgggcatcgcaagcaaacaccattccagcgactttctggagtttatttcaaatgattaggaacccagaagcaatgaaagcagctactgaagaagtgaaaagaacattagagaatgctggtcaaaaagtcagcttggaaggcaatcctatttgtttgagtcaagcagaactgaatgacctgccagtattagatagtataatcaaggaatcgctgaggctttccagtgcctccctcaacatccggacagctaaggaggatttcactttgcaccttgaggacggttcctacaacatccgaaaagatgacatcatagctctttacccacagttaatgcacttagatccagaaatctacccagaccctttgacttttaaatatgataggtatcttgatgaatacatgccctttggatcgggagctacaatatgtcctggaagattgttcgctatccacgaaatcaagcaatttttgattctgatgctttcttattttgaattggagcttatagagggccaagctaaatgtccacctttggaccagtcccgggcaggcttgggcattttgccgccattgaatgatattgaatttaaatataaattcaagcatttgtgaatacatggctggaataagaggacactagatgatattacaggactgcagaacaccctcaccacacagtccctttggacaaatgcatttagtggtggtagaaatgattcaccaggtccaatgttgttcaccagtgcttgcttgtgaatcttaacattttggtgacagtttccagatgctatcacagactctgctagtgaaaagaactagtttctaggagcacaataatttgttttcatttgtataagtccatgaatgttcatatagccagggattgaagtttattattttcaaaggaaaacacctttattttattttttttcaaaatgaagatacacattacagccaggtgtggtagcaggcacctgtagtcttagctactcgagaggccaaagaaggaggatggcttgagcccaggagttcaagaccagcctggacagcttagtgagatcccgtctccgaagaaaagatatgtattctaattggcagattgttttttcctaaggaaactgctttatttttataaaactgcctgacaattatgaaaaaatgttcaaattcacgttctagtgaaactgcattatttgttgactagatggtggggttcttcgggtgtgatcatatatcataaaggatatttcaaatgattatgattagttatgtcttttaataaaaaggaaatatttttcaacttcttctatatccaaaattcagggctttaaacatgattatcttgatttcccaaaaacactaaaggtggttttattttcccttcatgttttaacttattgttgctgaaaactctatgtccggctttaactatcttctctatatttttatttcattcacattaatgagaagagttttctcagagattaaaaaaggtagtttttctgtcattgttaaatacacattatcactgaaaaaatgtagcttttatgatgtatgttttaaagttaaaactggatggaaatagccatttggaagctttggttatgaaacatgtggagtgtattaagtgcagcttgacattatgttttatttaaatgctttttatcgctaaatgacttgcagatgaaaaaaactaaggtgactcgagtgtttaaatgcctgtgtacaacaatgctttgataaaatattttaaggtatgagttatcagctctatgtcaattgatatttctgtgtagtatttatatttaaattatatttacctttttgcttattttacaaatattaagaaaatattctaacatttgataattttgaaatgattcatctttcagaaataaaagtatgaatct

SEQ ID NO: 413946 - DNA, 1841 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413947 - DNA, 2231 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcaaaaaaaaaaaaaaaaaaaaaaaacaaaaaaaaaaaaggggggggcccaaaaaaattcccccggggggccccaattttgcggcccccggttttttttacaggggggcccctaaatggaagggcgcaaatataaaaccaataaggcacgggcaccgctgagtataaaccaacctcgtcgggacggggaaaaacgtcgccaccgggggacactctgggcgaagaggacccccaatcgcggggggggggacaatgcggggacaagtacaccaccagagaaatttacacgcccccaggggcaataaacaaaccttcagaggctactatgggtggtacaccacgcgacactagcaggcgtaagacaatctgccagcaaatgcaataagaagttcaa

SEQ ID NO: 413948 - DNA, 619 bp, Homo sapiens
ccccaactgaagggttaagaaagatccaaacggggcccccttgattattcaatgctggagaatacaaaaaagctgggacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413949 - DNA, 404 bp, Homo sapiens
ccccgggctgcaggaattcggcacgaggcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413950 - DNA, 837 bp, Homo sapiens
ccccgggctgcaggaattcggcacgaggcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcagcatccttgtttgatttcttctagggccgtaagtcttgttttctctccagatgtttatctgtgtgctgtggtaggaattaatccaactgaagtgagcctaacgctttttaaagtgactgaaggcttttccaccttaattactgcctgctttaattctggactgccataagtgatataagctataatttgagcagttactgtctttctgagacagattcttgagcctaactgaccaatatcacagctagtaagtggaagagctagaaccctaaccactatttgctacaccatcttataaatgttaaacaaggacacaccatcacatatcgagattctcttgcccttattatgggaattaagagcattttctagactgaaactccctattttcaactctgccactggtaagctgggtaacccaggggttatatat

SEQ ID NO: 413951 - DNA, 1300 bp, Homo sapiens
ctcttttctgtactttttaactctctcgttagagatgaccagagctggggatgcgggcacctgtcttccaggccctcttgctgtgtggccgcagactggtggttcagcctcttaactcggacatgaggtcgaataatctgttttggtttactgctatttctggagaggcgcggagctgaaataacagagctgttgaaagggctgggaattctgcgaggctcactggtctagctcagtatctgcgttcttaaaatggaacctacttcatgaggtctttggggagattgagacttggatataatgtgcctagcacttagtcctccgtaaatgttcactcttttgtgatcattgtgccttctgtgatttatgaagtgtctcttctgagttaattcttttaaaaaaaaaaaagtgtctcctccaacagacacggacccatcagcaggtcactgcctaggatctcaacactagagatcagggagtggcatcagcctctcccttttctaaattggactgggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagaccgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagaggtaaaactacttaaggtcaaactcttttatccattgtatacccttccttggtgaatgttctgatatttgcttcccatcccaagttgtttcagcccctattagaatacaattgaatatatgattaaaagttaaactaggctgggcatggtggctcatgcctgtaatcccagcactttgggagcctgagttgggcagatcacttgaagccagcagtttgagaccagcctagccaacatggtaaaatcccgtctctacccaaaaatatacc

SEQ ID NO: 413952 - DNA, 423 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccacttttgctagtcagcttttacgagg

SEQ ID NO: 413953 - DNA, 496 bp, Homo sapiens
aaacgacggcagtgaatcgagctcggtaccatctcgtgacggcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaataatcgccggtcacgagatggtaccgagctcgatcactgccgtcc

SEQ ID NO: 413954 - DNA, 702 bp, Homo sapiens
ctgagggggctctttccctcagcaggtgttcccgttgcttacagaagcaaactaaaggacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgcatagaaaccaaaagaaacaaaaagaaaacacacaaaatagagcgggcgggccgccctcataaaatatttcccccgcgagggggcccacaccagtgtataacgcgcatataccccaggtttgtcttggtgtaccacatggtggcgtccccctgtaatacaaggaacagcagaatattattagaatgccaggagcgcgcggtgtgcccgctgcgtgtcttatcacaagaacggtctcgaggaggcgcgggagatacacagagggagcgtatcagatctgaagagggagagaactcatctgatgggagtgaaagagagagacacctctccatatgtttccatagcggggagcgtggtgagatccctaataacgatgtgggacacaaagaaacttggccccacctatgggaggaagaaatttttcctaaggagggcactcgttgaagggggagaaataaattcttatagac

SEQ ID NO: 413955 - DNA, 1817 bp, Homo sapiens
gcatgcaacacacagaaaaccatatgctaggatgagccgtcggtaaatggacgaggggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413956 - DNA, 1676 bp, Homo sapiens
aggccgggcgcggcgaggctgggcgctgggcggctgcggcgcgcggtgcgcggtgcgtagtctggagctatggtggtggtggcacgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413957 - DNA, 2480 bp, Homo sapiens
ctcttttctgtactttttaactctctcgttagagatgaccagagctggggatgcgggcacctgtcttccaggccctcttgctgtgtggccgcagactggtggttcagcctcttaactcggacatgaggtcgaataatctgttttggtttactgctatttctggagaggcgcggagctgaaataacagagctgttgaaagggctgggaattctgcgaggctcactggtctagctcagtatctgcgttcttaaaatggaacctacttcatgaggtctttggggagattgagacttggatataatgtgcctagcacttagtcctccgtaaatgttcactcttttgtgatcattgtgccttctgtgatttatgaagtgtctcttctgagttaattcttttaaaaaaaaaaaagtgtctcctccaacagacacggacccatcagcaggtcactgcctaggatctcaacactagagatcagggagtggcatcagcctctcccttttctaaattggactgggggacggagggttgatgtcatagcaagattgcagccttcactagattaatgaggccaggttggatcctgtttaagagaactggagacaggaagcagcgggggaatagatggggaaagaggaaagttccttatgatgcaagatgaatagtgtgtgtgtccagccccagtgctgtgacggggatgagtctgaggtggacggatgatgcaatataggagagaataaagcaggtcttcgagctagattgacagaagaccgtattttttattttgttttattgaggggaggagcctgaagtgtattttatcattagtctgtcttatactgtaaataaaaatgaaagcaccagctggtaaagttttcaaataaagacataaataaggtttgatatgactcagtgtggtatgttccttctcttcctaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413958 - DNA, 1802 bp, Homo sapiens
atccacctgccttggcctcccaaagtgttaggattacaagtgtgagccaccgagcctggccaagatagtttaaaaaaaaaattatatctacattaaagccacaagtcaccctttgctgaagtcagtattagtagttggaagcagtgtgttattcttgaccccatgaagtggcacttattaagtagcttgcttttccataattatggcctagctttttaaaacctactatgaacaccacaagcatagagttttccaaaagttcaagaaggaaaggaaaccaattatactgaatcaggtagattcttaactgaaataattagatgttttaatagcctcttatgaactttcttccagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413959 - DNA, 1407 bp, Homo sapiens
aaagttacatgatacaatcgagcttgtacccaggcatgcagcttgtgggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413960 - DNA, 1787 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagaggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413961 - DNA, 2050 bp, Homo sapiens
  misc_feature (1821)..(1821): n is a, c, g, or t
  misc_feature (1823)..(1823): n is a, c, g, or t
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttcttttaaataaatggagaaagcacctttcagaagctacntngcaggaaaaaattccatcaagcatttacatagtaaatttctataatttcacaaaagattcttgatcttacttgaagtatacatgaggggaaagagccccctcagcaggtgttcccgttgcttacagaagcaaactaaaggaacctaaaactggaggcaagcccggatgccaaaaaggggggaagagaaatgataaagaaccattcataaaatccatggcttcttcaa

SEQ ID NO: 413962 - DNA, 2725 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaataatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413963 - DNA, 2686 bp, Homo sapiens
atccacctgccttggcctcccaaagtgttaggattacaagtgtgagccaccgagcctggccaagatagtttaaaaaaaaaattatatctacattaaagccacaagtcaccctttgctgaagtcagtattagtagttggaagcagtgtgttattcttgaccccatgaagtggcacttattaagtagcttgcttttccataattatggcctagctttttaaaacctactatgaacaccacaagcatagagttttccaaaagttcaagaaggaaaggaaaccaattatactgaatcaggtagattcttaactgaaataattagatgttttaatagcctcttatgaactttcttccagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaataatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413964 - DNA, 1353 bp, Homo sapiens
  misc_feature (34)..(34): n is a, c, g, or t
cgactctaaggactggctgactacggggaagcangggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413965 - DNA, 1388 bp, Homo sapiens
acgggaggatcctttggcagagtgatgggatggctgcccatggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413966 - DNA, 1814 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcagtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413967 - DNA, 2155 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatataggacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413968 - DNA, 3039 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaataatcaaatggtctaagattgacagtagcacagttttactctgtgaaggtaatgttcaggacaaatttcaagaaaactagaaaaccattctttacagctgaaatctttccctaaccattgttatttccacttttaagtcctcaagagatgagaaaagggaggtaaggcttccttatacatttcctgcacaatgaaacatttttcctcctccaggcaaagattcaagcagaactggcaaatatcttatcttgctcttctcaataataataatgttgttagataataaagttctatagcaatttaaccctagaatctttttgaaaagtaattctttaaagttgagaatcacagctgtctagcaagcatttccttgggcacttgaagctgtttattcactttggtctttcctcccaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagaggtagggatcattctgacttattaaagagctatataaccagttaattccatctgtttgatgcttgacatccctaactagacagatgagggttgaagttagtttttggtggggttggaggtgaacatcaactaccttcctagttccaggtaatataggacatggagtgaagtgtagataaatgggtctggtgggtcccgaggtcatcttatcacataatgactaatttacattatggaacccagtacaaagtgttccagttagattttccattgtattctgacagttgtacttcatttaatttttgcctcttacagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413969 - DNA, 1787 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtatacagtcctagagaattcctctatttgttcagatctcatagatgacccccaggtattgtcttttgacatccagcagtccaaggtattgagacatattactggaagtaagaaatattactataattgagaactacagcttttaagattgtacttttatcttaaaagggtggtagttttcccttttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413970 - DNA, 1691 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacatgtcctctctgcttggtgtaaaccattcttgggaggacacttttgccaatgaactctttccccagctgattagtgtctaaggaatgatccaatactgttgcccttttccttgactattacactgcctggaggatagcagagaagcctgtctgtacttcattcaaaaagccaaaatagagagtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413971 - DNA, 1171 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgacctcgttccggagctgggtatctcaaatctgctttcatccagccactgcccaaagccatcttcctgcctactggatgcttacagtgactgtggatacgggggttccctttccccattcagtgacaacggcgaaatcctcggagcacctca

SEQ ID NO: 413972 - DNA, 655 bp, Homo sapiens
ccccgccgctcgccgggtgcaagcagttttcctgttctagcctcccaaggagctggtactgcaggcgcgcgccaccacgcctggctaatttttttcgtatttttaggagagacggggtttcactatgttggccaggctggtcttgaactcctgccctcgtgatctgcctacccggggagggggccccctccccaggtattgtcttttgacatccagcagtccaaggtattgagacatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactacccatgcaattaaaaggtacaatgca

SEQ ID NO: 413973 - DNA, 1145 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagtgaaaatcgaggaagcacctctcagcccctcagagaatgatcaccctgaattcattgtctcagtgaaggaagaacctgtagaagatgcgagatagtagtagggtcgtggtgctggagtttcagttgagtagtcggtatagcggtagtagttaggataatatggataggtaaattaagtatggttatgttaggtgtacggtaggctgctatta

SEQ ID NO: 413974 - DNA, 1200 bp, Homo sapiens
  misc_feature (971)..(971): n is a, c, g, or t
  misc_feature (973)..(973): n is a, c, g, or t
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcccctagtcttagagataccctctgagacagagagccaagctaatgtggtagttttaaataaatggagaaagcacctttcagaagctacntngcaggaaaaaattccatcaagcatttacatagtaaatttctataatttcacaaaagattcttgatcttacttgaagtatacatgaggggaaagagccccctcagcaggtgttcccgttgcttacagaagcaaactaaaggaacctaaaactggaggcaagcccggatgccaaaaaggggggaagagaaatgataaagaaccattcataaaatccatggcttcttcaa

SEQ ID NO: 413975 - DNA, 909 bp, Homo sapiens
  misc_feature (891)..(891): n is a, c, g, or t
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaggacccagttccttaccagcctccctttctctgtcagtggggacgtcatcagccaagctggaagccattaatgaactaattcgttttgaccacatatataccaagcttgcagggnaccgagctcgagtcgtaa

SEQ ID NO: 413976 - DNA, 950 bp, Homo sapiens
  misc_feature (813)..(813): n is a, c, g, or t
  misc_feature (844)..(844): n is a, c, g, or t
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggggaatgaagtgaggccagtggccgggtctgctgagtccgcagcactcagactacgtgcacctctgcagcaggtgcaggcccagttgtcacccctccagaacatctccccatggattctggcggtattgactcttcagattcagagtctgatatcctgttgggcattctggacaacttggacccagtcatgttcttcaaatgcccttccccagagcctgccagcctggaggagctcccagaggtctacccagaaaggggggggggcaaaaacgccccacccaaaggggttntcgcttaccagccctccctttctctgtcagntggggaaccaggtccaatcagccaagctgggaaaggggccccaaaatttcaactgaacctaattcgttataggaaccaaagccaaataatataaccaaaagcccca

SEQ ID NO: 413977 - DNA, 1037 bp, Homo sapiens
aggccgggcgcggcgaggctgggcgctgggcggctgcggcgcgcggtgcgcggtgcgtagtctggagctatggtggtggtggcagccgcgccgaacccggccgacgggacccctaaagttctgcttctgtcggggcagcccgcctccgccgccggagccccggccggccaggccctgccgctcatggtgccagcccagagaggggccagcccggaggcagcgagcggggggctgccccaggcgcgcaagcgacagcgcctcacgcacctgagccccgaggagaaggcgctgaggaggaaactgaaaaacagagtagcagctcagactgccagagatcgaaagaaggctcgaatgagtgagctggaacagcaagtggtagatttagaagaagagaaccaaaaacttttgctagaaaatcagcttttacgagagaaaactcatggccttgtagttgagaaccaggagttaagacagcgcttggggatggatgccctggttgctgaagaggaggcggaagccaaggtaaatcatctcctttatttggtgcctcatgtgagtactggttccaagtgacatgacccagcgattatgtttacagtctggacttctgatcaagagcgttcttgaaattttccttcagttttaagacattttcatgcaggcagagtgttcttcccctaaaggcacttgacactcattttttaagtgtgtagtgaacagtactaagatctaataatgaaaacaagttacatggctccctaagaacaagtactaacaaatgcagtagccaacaagattaccatgcaatcattaaggagaaccaaagtaagagagccactcaaaccagattttgaacgctactaaaattaaagtagttctttgatgaatatgaatgagtagggaaaggattctttgtaatagtgatacctctgtggtaagagaagggtggtatgtgagttttagtctacagattatggcaaattcagtgacaataatcgccggtcacgagatggtaccgagctcgatcactgccgtcc

SEQ ID NO: 413978 - DNA, 3480 bp, Homo sapiens
ggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 413979 - DNA, 2185 bp, Homo sapiens
ggcctcacggtcctgctgatatgtgacatcacccccggaggcccagctgtaaattcctctctttgtactctttctctttatttctcagaccagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 413980 - DNA, 3101 bp, Homo sapiens
ggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 413981 - DNA, 3426 bp, Homo sapiens
ggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggtgagttttcaggcatcactggaagatgaagtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 413982 - DNA, 3047 bp, Homo sapiens
ggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaacatatccaagctacaggcctgattccctttcagatggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattaac

SEQ ID NO: 413983 - DNA, 313 bp, Homo sapiens
aaaactacaacttaagaggaaacaaagataatacagaaagagagaagggaaaaaaaaaacttttctccactgatatccccagagaaatgggagaagacactgcacccatgaaacaagaacagaaggagaatgttataaaaaagacattcacgccagacgctttggctcatggctgtaatcccagcagtttgggaggctgaggcgggcggatgacctgatgtcaggagttcgagaccagcctggccaacatggagaaaccccgtttctactaaaaatacaaaattaaccgggcatggtggtgcatctctgtaat

SEQ ID NO: 413984 - DNA, 1067 bp, Homo sapiens
gaaccctcctgcttgttctcttgttatctaatacccctattgacagcgcagcttagatcattaatggagagcttgacctcatctgataccttcactgaaggaaacaacttagtgtcttttgtgttgaacactgaggtaaaaaattggaatagttgattatatgaactctgctaaaattgagtgcattttacattttttaaggccttgttgggccctggttaaataattatttttaaaaatccttaaggagcctattataaacagatctgtggtcttaatgaaatgtgattaatactgtgcattattttaagaacttttgacttttcaaaaaacttttacaacatttcccatttgatagcggcataggtttaagcacttctcatctctaagttagtggacaaaaaaccctcatggatagtctaataatgtttgctacaagtccatgttgagttttatactccattttattttcagttttaaaaactgtggttaaatatgtgtaacataaaatttatgttcttaaccattttttgcgtatacagttcgctggtattaaatacatttaaataatgtcatggaatcattgctaccacccatctctgtaaccttttgatcatgtaacactgaagctctgttcccattgaactctattcctcctttcccgccaagtccctggcaaccacgattcttctttctgtcttctgaatttgactactttgggttctcatatactttaggagtcacacagtatttgttttacttagcataatgtccccaaagctcatgcatgttgtagcctatgttagaacttcctaatgtttcaggccaaatactattccattgtatggataggccacattttgcttttccattcctctgtccatggacacttgtattgcttcatgttttagccattgtgaatcatgctgttatgaacgtgggtgtacagatagctcctggagactctgctttccatttttttggctaaatacccagaaatggagttgcttttacattccaattttaatttaaaacattcatatcattgagtgttttacttaatagta

SEQ ID NO: 413985 - DNA, 572 bp, Homo sapiens
tagggacctgtaatacctttgtagagtgaaaaggcttcttgtggactttgtgtaaggtgttgatgtatcaaggaagcgttccacagggaggtgagtaatgcaagaccagggctgaagtttagactacacaggacatgtttagggatgagtgagtagttctgtgagcgagacaggaggatgccggggtagagggaagttggaacgtaagctagtgggttctacagaggaagggctttgatctgctgatcagaaggtttgggccaagcccaggaaaagggatagcagcaacatacgtttgtttattcatttgcttacttacaacaaacgtttattcattatttataatgcaacaagcattaacctaggtgctaaggagagaaaaatgagtaagacacagtttctttcctcaaggaaatcacagtctgttggcggagataagtagtaatggtgcctaatataggtaacacttgctacctgctccaagaacaaagttaagcaagtgattaagttaagcaatgcttagaggtagaggatgtaagaatggccttaaaaaatgtgtcttctgagatgag

SEQ ID NO: 413986 - DNA, 361 bp, Homo sapiens
gatgatagctgtgcccagtttttgttacatatgatattgaaaaactagagtgataggattccaaagaaccactgctgttgtctcaatgtctgtgtcctcccaaaatttatatgttgaaatcctaacccccaaggtaattgcattaggatgtagggtctttggaaagtgactgaaggctctgcctcttgaatgggattaatgcccttataaaagagacccctgacatctgcctttccccttccaccatgtgaggacacagtgagaaggtgccattcatgaacctgaaagtgagccctcaccagacaccaaactggttgagcattgtcttcccattctctagaactataagaaataaatttct

SEQ ID NO: 413987 - DNA, 868 bp, Homo sapiens
taacacccatgcaacgagtctgcgaggccgaatggaagccagctggtgcaggggagagagcaagagagtctggcagaaggtgcacctggagaaggaagtagaggccaggccagcatatgcttacaaaatttgaagaccacaaccactctccaaatacaaatgcagcaagtgatttgaagatcatagaaatgataatacaggcaaaaaatgcaagaaatctcccctgccaaattattcaactatgtatgacttctgccttttcacagcgccaatttgccatgctatgcgtttcatctttgcatcattttcaatactggatgtataaattgtgtaaagactttcagagttctaattcattttatgcattttttgcaaatttgattccatgaaagtgcattatcacatcatcgactgtgtgtaatcattgtgtgtgcatataaaaatgaagagataaatgaagagatgtccgttttatacatctgcatttgtaaaatataaaatttcttaagatcttggctgtttgggagactgcgtatgtagtggtgacctatcatggtttttgatcaatcttgtcaaaagacttagcttgtctgtcatggcatttcagatgagtgaatttcagatgttataaagctgggtgcacacaatagccaaccacagtgatatatatttatacattttgctttttgacatacttctttatgagtatggtttgtctgctcataatttttatactcttgcagctgttgttagtatacctgagtgcttatgtttgcaaatgcatgtatgttattaatgcctattttgttgtatacaatggcctatgaagtgttctgttgtgtttttatgtttatcaaataaattcccc

SEQ ID NO: 413988 - DNA, 401 bp, Homo sapiens
taacacccatgcaacgagtctgcgaggccgaatggaagccagctggtgcaggggagagagcaagagagtctggcagaaggtgcacctggagaaggaagtagaggccaggccagtgtggagggaactgggaggacctgtctgaccacaaacaacccacctgaggaggccctgctgctcccggaggatgctcctgccagagttctcctagttccttgcaaggagccctggaaaaacaatcccaccctgggtctaccatagtctcggggacttttaaaccaatgcccagctagaaaaaacatctcaggcagtttcgcggatagaagaggaaataatattaagagcctgccatatgttgaatgtttactatgtctcagcagaatataaatgctttagtttcttac

SEQ ID NO: 413989 - DNA, 389 bp, Homo sapiens
cactggaaggtttcattttaattgcttgtgattatgtaaaatcttttctgagggttttgagaatcagtgtgacagaattacaacccacataaggttttccccttttctgcctttgggagaattcccactcaaagagccaggtcccattaggattggagtcagcagggctgaagatggctagaggacactgcagggagggagaaagcacttggagatgagatactcaattattgaaactgacttgcctcctcaagaaatctggaactttaaacccagttccagaattctctcctgattccagttaaagaaacctactacctaataacttaggcagccatttaggtgggatgtttcactttctgaaattcttagctttcttccccgtaaaa

SEQ ID NO: 413990 - DNA, 253 bp, Homo sapiens
aggagatattattttagctattttgcaacaattttaaaattatattttccaatactttaaagcaatttttatctcagcttcagaagcatattaaaacaattcatatttcaataaaaggcaaacatttatatggtgatttctgaaatgtaatataaaatgcatttctttaacatggcattttgacataagggaacttgcaaaaatataaatcaaagccgtctagcaaatattaattttagatcctactttacct

SEQ ID NO: 413991 - DNA, 441 bp, Homo sapiens
gagactaccgtgtgcctgacactgtcctaggcattgaagacacttttaaattaaatgtgtctgatgttatttccagagatggccattcactggctcgcattatattttgggaccattgtaattgttccaaacgggagccaaatgagcaaaactttgcgaaataattctgagtcccttgctggaaagcctcacctgaatgcagcccacacatttatgatacactacaaaggcttcaaggtcatgagatgcctctgtccaaagaagaagaagagcacccctgcctgccctgcatctcttaccacctctcatttcttccctcctggcaccatctactgtcaagaagagaatcagactccctgaaataattgagacactgacattcctttttgtgtgtatttttttggcaaaggctctaattgaacaggcattaatagagggctc

SEQ ID NO: 413992 - DNA, 766 bp, Homo sapiens
atatgttatatgtgggatctgggaagccactgtaaagactttggcttttatttgggagtaaaacagagagtcactacagggttttgaacagaagagtaacacgatctgattcatgttttaaaggattaatctggctgctttagaaaataaactgttattcagagaagaaagagagaggagagaaataaaatgaatgcccaccaacaagaaaatggttgagttataccagttggctaagaaagattttagagagggattattgaatgaaaatggcaaaatggaaggaagcatattaaaatctactttggaaagataaataaccaccaaagagaggaatatgggaaaggaggaaagcaagcaaacagaaagactatattttaaaaaaatgcaaacatgatataattatacacatctttatgtcaaattatatgggtgtgtatgtctttatgtggcatacatagcctctggggagtggattcccaaatcacctataaccacccaatgggttcttcctgcgtgctgcccagatagggccgatttatcaagacagaggaattgcaatagacgaagagtttaatatacatagagtcagctaaatggaagactggtgatttactgtcacttgaatcagcctccccttaaatttgaaggctagagttttgttatttttctgtttgttttttgagatacggtctcagtgtatcacccaggctggagcacagtgacacgatcatgcttcactgcagcctcaacctcccaggcccaa

SEQ ID NO: 413993 - DNA, 260 bp, Homo sapiens
  misc_feature (127)..(127): n is a, c, g, or t
actagagacaactcataaacacaggttgacagtacaaactgtatactttgaactatgagacaatttgaaggaaaggcacaattatcatgaggttatataaagctaatgtgttatatttggtctaaangacaatgggctaatataaaggagaggttcatgatgaaatattatattatcctggcagctgtctacaatatggactaacatcaggagaagcacaatattaatactaacactaataatatcaaacacagaccact

SEQ ID NO: 413994 - DNA, 457 bp, Homo sapiens
attatttgttaatttaagaaagccagcagggacaaaaaaagacacttctttgaccttaatacagcaaaagatgtgaaaacatggagatgtgtattttcagaattctttacccatcactctatcatttaagattttaatggacttcaagatgctaatattttgaaaattctctggaagttcacctggttctcaactccaagctgaacgaggaccacggacacccaggtgtaggtattttgtaagccacagcttgagatggtcatacctggttatgctctgtaaggagctaagaaggcaggaccatatgatcctattaaaaggtagcactggatggccttctttttagacgtgctccactgaagccttttagtctacatgtgaaggaaccaaggcccaacaagtttaggtgactgtgttagtcattggcagaatcatgtgtggagcctgggtcagctga

SEQ ID NO: 413995 - DNA, 419 bp, Homo sapiens
tagaggttttataatttaaccttttttctcctttttatctttaatcttcactgtatttcagtcatggtcttgaggtttccaaagtgcccctttaagattccagcaaagaatataccagctttttaaacatggggaataaaacaagaacaatgtgatagcatagtgtaatggtgcccatagaaataaacaataaaaagaatttaaagagagaacccaggagtcaatttcataaatgccaccattacattacttaggttaagcttttgaatttatctagaaaaatgtcattggctaagacattaacatttatagaggaatgcaaaagtgcaaaattaaagttcctaagaatcaagtccagaaaaatagaaaatgtgtaaaggctgttgttctcagtttggcaaataaaataaaaaaaaaaa

SEQ ID NO: 413996 - DNA, 662 bp, Homo sapiens
  misc_feature (68)..(68): n is a, c, g, or t
  misc_feature (110)..(110): n is a, c, g, or t
ccataatatgatttatctccacactagcagagaccaaccagaacccccttcgaccttgccgaagggangtccgaactagtctcaggcttcaacatcgaatacgccgcagnccttcgccctattcttcatagccagaatacacaaacattattataatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtc

SEQ ID NO: 413997 - DNA, 1158 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtc

SEQ ID NO: 413998 - DNA, 1676 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagaactctcactctgcacaaggcacagccctccctgctcactcgcacgcttgccatctcgcacacatatgcttcagccacatctgcaactgcacgctctccgcaccacacccatcccacgcgcacacctcaccactcggcacatcgcacacgccacgcaacatcaacctcacacacgcccactaccaacccacacaaaaagaaaacacacatgggaccaaggtagacacaggaacatgacacaaccacatccactaccgccctccccacacccggctaccagctcgccaccgccaaagcctcaagcctccatagacaaacgccgcccctccgaagacactgcagcgccccacacaacagccccccaacgcactaacaacacacaaacaacgtccgacccatacccaatgtgccgagacgaccacgacgaaacacagcagagcagaaaagcgacaacagggacccctacactgccacacaacaaccataaccccccggacagccaagcacgacgcctgtcggacaacccaccgaggacaaggacgcaagcaggcggcaggcgccaagccaggagaggacggcgccgcttcggcacctgcagacgcagcgaacaagcgacagtccgacagagcgacgccaggcaccgaggcgagaaaacagagaagcctaggcaaccacgaacgcgacgagccgcgcgatctccgacacggcgcgcggggcgcatgtaaaccaaggaaca

SEQ ID NO: 413999 - DNA, 639 bp, Homo sapiens
agtattagcttgatatggactcttctatttaatctgcttctgtaattatgctgaaagtttgcctgaggactctatttttttattagagttatatttaaagcttttcatgggaaaagttaatgtgaatactgaggaattttggtccctcagtgacctgtgttggggataacatgcgatgttatcgcccaacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggggagtgttggggaaaatcagtgatgttatcgcccaacacagtacttgggttttaaaagacgggccagtaagaggtaataaaagagtccagaagtattatctataaggaggaattgtaacccttaggactcaagacggcgagaccagagaagagccctgcgtctttactcactgcagctatggttacactgcatggctccaaaaatgagtattatgttggtgccatgctgttgaacatgcttgacatg

SEQ ID NO: 414000 - DNA, 589 bp, Homo sapiens
tgatgtatcccaacactactaaaaatcaaaaggaataatagctgggcgtgatggcgggtgctgtaatgcgatgttatcgcccaacacctctataaccgccttctcttcttttcagaactccttgtttctcgtcccgttttttatgattacaaaactcttgcttccaccctggaagataactgctatagatgcctgtatgtaaatggtgctgtctccagcaactggcatgctgaagaagaattgattcacggggtataagtgttgggcgataagttatcgcccaacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggggagtgttgggggtgatttatccccaacaccaacacttttgaagacttaaaaagtttcaagattgtggtttttatcttgcaatttactgtgttgggcgataa

SEQ ID NO: 414001 - DNA, 1104 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414002 - DNA, 1626 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagataaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaaaaaaaaaaaaaaaaaaaaaaaaaaaaaaagggggcggaggagagacataatcaattcgtgcgcagaggaggaaagaataggtgaatacagaggatccgtataaacaagaaagagaaggaagccaaaaacatgatataatacaatacgacaatacgctgagggtagacagaggacagatatgcggaaggacaacaaacaaggacgatccatgactgtgagaacacacatgctgtgcggaggtggcataaagcccaacaaagccgcagtatatctacaaaaa

SEQ ID NO: 414003 - DNA, 1733 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagaactctcactctgcacaaggcacagccctccctgctcactcgcacgcttgccatctcgcacacatatgcttcagccacatctgcaactgcacgctctccgcaccacacccatcccacgcgcacacctcaccactcggcacatcgcacacgccacgcaacatcaacctcacacacgcccactaccaacccacacaaaaagaaaacacacatgggaccaaggtagacacaggaacatgacacaaccacatccactaccgccctccccacacccggctaccagctcgccaccgccaaagcctcaagcctccatagacaaacgccgcccctccgaagacactgcagcgccccacacaacagccccccaacgcactaacaacacacaaacaacgtccgacccatacccaatgtgccgagacgaccacgacgaaacacagcagagcagaaaagcgacaacagggacccctacactgccacacaacaaccataaccccccggacagccaagcacgacgcctgtcggacaacccaccgaggacaaggacgcaagcaggcggcaggcgccaagccaggagaggacggcgccgcttcggcacctgcagacgcagcgaacaagcgacagtccgacagagcgacgccaggcaccgaggcgagaaaacagagaagcctaggcaaccacgaacgcgacgagccgcgcgatctccgacacggcgcgcggggcgcatgtaaaccaaggaaca

SEQ ID NO: 414004 - DNA, 1047 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414005 - DNA, 938 bp, Homo sapiens
gctaaagaggttgcgaggctgggtaatcggccgagggccgttcgcgcccgtcctgtcggccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414006 - DNA, 935 bp, Homo sapiens
aactaggctaggtaggaggctgggtgttgatcggccgagggtcgcgccgtctgtcgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414007 - DNA, 824 bp, Homo sapiens
aacccgcccccacctacacccccctcgctcctgacgaaaagagaaaccttaagtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414008 - DNA, 1638 bp, Homo sapiens
  misc_feature (927)..(927): n is a, c, g, or t
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaacgcacccacaaaagaaaaaaacccccacccnacacaccaaacaacaacaaaaacacaccccgagagtgaagtggataggagtgcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagataaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaaaaaaaaaaaaaaaaaaaaaaaaaaaaaaagggggcggaggagagacataatcaattcgtgcgcagaggaggaaagaataggtgaatacagaggatccgtataaacaagaaagagaaggaagccaaaaacatgatataatacaatacgacaatacgctgagggtagacagaggacagatatgcggaaggacaacaaacaaggacgatccatgactgtgagaacacacatgctgtgcggaggtggcataaagcccaacaaagccgcagtatatctacaaaaa

SEQ ID NO: 414009 - DNA, 711 bp, Homo sapiens
acggcagtgatcgagctcggaccgcatgaagtatctgagaaagcagcgaggctaggaaaggtttctcctatttggtaactggagtaactactgtgggtgtcgcatatgctgccaagaatgccgtcacccagttcgtttccagcatgagtgcttctgctgatgtgttggccctggcgaaaatcgaaatcaagttatccgatattccagaaggcaagaacatggctttcaaatggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414010 - DNA, 1042 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggtggagaggcaaacccctgtttgtgcgtcatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaa

SEQ ID NO: 414011 - DNA, 1130 bp, Homo sapiens
  misc_feature (68)..(68): n is a, c, g, or t
  misc_feature (110)..(110): n is a, c, g, or t
ccataatatgatttatctccacactagcagagaccaaccagaacccccttcgaccttgccgaagggangtccgaactagtctcaggcttcaacatcgaatacgccgcagnccttcgccctattcttcatagccagaatacacaaacattattataatagaacccagaaggaaattgagcaggaagctgcagttgaattatcacagttgagggacccacagcatgatctagatcgagtaaagaaacctgaatgggttatcctgataggtgtttgcactcatcttggctgtgtacccattgcaaatgcaggagattttggtggttattactgcccttgccatgggtcacactatgatgcatctggcaggatcagattgggtcctgctcctctcaaccttgaagtccccacgtatgagttcaccagtgacgatatggtgattgttggttaagagacttggactcaagtcataggcttctttcagtctttatgtcacctcaggagacttatttgagaggaagccttctgtacttgaagttgatttgaaatatgtaagaattgatgatgtatttgcaaacattaatgtgaaataaattgaatttaatgttgaatactttcaggcattcacttaataaagacactgttaagcactgttatgctcagtcatacacgcgaaaggtacaatgtcttttagctaattctaattaaaaattacagactggtgtacaagataaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaaaaaaaaaaaaaaaaaaaaaaaaaaaaaaaaaaagggggcggaggagagacataatcaattcgtgcgcagaggaggaaagaataggtgaatacagaggatccgtataaacaagaaagagaaggaagccaaaaacatgatataatacaatacgacaatacgctgagggtagacagaggacagatatgcggaaggacaacaaacaaggacgatccatgactgtgagaacacacatgctgtgcggaggtggcataaagcccaacaaagccgcagtatatctacaaaaa

SEQ ID NO: 414012 - DNA, 761 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggggtgatgttatcgcccaacacctgccaccccactcttaatcagtggtggaagaacggtctcagaactgtttgtttcaattggccatttaagtttagtagtaaaagactggttaatgataactatgcatcgtaaaaccttcagaaggaaaggagaatgcttttggaccactttgttttcttttttgcgtgttggcagtact

SEQ ID NO: 414013 - DNA, 808 bp, Homo sapiens
actgcagaatttcctttccggcggcgcgctgtcgtcacgcgtcccgcgcctcctcgcgcctgcgccgtggttggaaggtcgtccctgtgaccggcttggcggttggagcggctgtcgccatgttgtcggtagcagcccgctcgggcccgttcgcgcccgtcctgtcggccacgtcccgcggggtggcgggcgcgctgcggcccttggtgcaggccacggtgcccgccaccccggagcagcctgtgttggacctgaagcggcccttcctcagccgggagtcgctgagcggccaggccgtgcgccggcctttggtcgcctccgtgggcctcaatgtccctgcttctgtttgttattcccacacagacatcaaggtgcctgacttctctgaataccgccgccttgaagttttagatagtacgaagtcttcaagagaaagcagcgaggctaggaaaggtttctcctatttggtaactggagtaactactgtgggtgtcgcatatgctgccaagaatgccgtcacccagttcgtttccagcatgagtgcttctgctgatgtgttggggagtgttggggaaaatcagtgatgttatcgcccaacacagtacttgggttttaaaagacgggccagtaagaggtaataaaagagtccagaagtattatctataaggaggaattgtaacccttaggactcaagacggcgagaccagagaagagccctgcgtctttactcactgcagctatggttacactgcatggctccaaaaatgagtattatgttggtgccatgctgttgaacatgcttgacatg

SEQ ID NO: 414014 - DNA, 4623 bp, Homo sapiens
  misc_feature (1296)..(1296): n is a, c, g, or t
  misc_feature (4513)..(4513): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatgctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414015 - DNA, 3514 bp, Homo sapiens
  misc_feature (1296)..(1296): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctataatcccaacacttcaggaggccgaggtgggcggatctgagt

SEQ ID NO: 414016 - DNA, 3422 bp, Homo sapiens
  misc_feature (1296)..(1296): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggtctcccgggatactctaggatcaactatcacg

SEQ ID NO: 414017 - DNA, 4605 bp, Homo sapiens
  misc_feature (1296)..(1296): n is a, c, g, or t
  misc_feature (4495)..(4495): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatgctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414018 - DNA, 1396 bp, Homo sapiens
  misc_feature (1286)..(1286): n is a, c, g, or t
tcccagctactcgagaggctgaggcaggagaatggcatgaacccaggaggcggagcttgcagtgagccgagattgcgccactgcactccatcctgggcaacggagcaagactccatctccaaaaaaaaaaaaaaaaaatcccacaaagaaaagctcaggctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414019 - DNA, 1931 bp, Homo sapiens
  misc_feature (1821)..(1821): n is a, c, g, or t
tatgcatgaacttcgggacgggtgtgtggtgcgggtcactggttgtggcgtgactgaggcgtggacaggtgtgcagtgcgggtcactggttgtggtgtggactgaggcgtgtgcagccatgtttgcatgtcacaagttacagttctttccatgtaacttaatcatgtccttgaggtcctgctgtttattggacaaattgcagtaacctcagctcctcacctgtgtggcctcctctcctccacacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatgctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414020 - DNA, 202 bp, Homo sapiens
atcgagtactcgctggccctggtcaccgtcctgaacgaggtgagtgcagcctggcaggggacctcacatctgctgcatgcgtgctggggaccaagacctgtacccctgcctggagctttgcggagggcttatcccgggccccagagataaatcccagtgaccctgaagcagcaccccgacgttccgctcccagcagccacac

SEQ ID NO: 414021 - DNA, 4499 bp, Homo sapiens
  misc_feature (1296)..(1296): n is a, c, g, or t
  misc_feature (4389)..(4389): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatgctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414022 - DNA, 3475 bp, Homo sapiens
  misc_feature (1296)..(1296): n is a, c, g, or t
  misc_feature (3365)..(3365): n is a, c, g, or t
tacctggagggccgctgcctcaattgcagcagcggctccaagcgagggcggtgggctgcacgtacgttcagcaacaagacactggtgctggatgagaccaccacatccacgggcagcgcaggcatgtgactggtgctgcggcggggcgtgctgcgggacggcgagggatacaccttcacgctgacggtgctgggccgctctggcgaggaggagggctgcgcctccatccccctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcagcgctgtcgccagggccactgcgaggagttctgtgtctacaagggcagcctctccggctacggagccgtgctgcccccgggtttcaggccacacttcgaggtgggcctggccgtggtggtgcaggaccagctgggagccgctgtggtcgccctcaacaggtctctggccatcaccctcccagagcccaacggcagcgcaatggggctcacagtctggctgcacgggctcaccgctagtgtgctcccggggctgctgcggcaggccgatccccagcacgtcatcgagtactcgctggccctggtcaccgtcctgaacgagcccccgcccaggagggcccatgtgcttaccctgttttgcccatgaagaaacagctcagtgttgcgggtcaatgcccacatcacacagcatctagcacgtaactgcaccccgggagtcgtgggcatctgctggcctcctgccggtctcctgccctgctgacagcttgctgtgccgcctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgcgcatcctgcaggcagagaccaccgcgggcaccgtgacgcccaccgccatcggagacagcatcctcaacatcacaggagacctcatccacctggccagctcagacgtgcgggcaccacagcgctcagagctgggagccgagtcaccatcgcggatggtggcgtcccaggcctacaacctgaccnctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggccgctacctgtctgaggaacccgagccctacctggcagtctacctgcactcggagccccggcccaatgagcacaactgctcggctagcaggaggatccgcccagagtccctccagggtgccgaccaccggccctacaccttcttcatttccccggggaccagagacccagtggggagttaccgtctgaacctctccagccacttccgcctgtcggcgctggaggtgtccgtgggcctgtacacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414023 - DNA, 2613 bp, Homo sapiens
  misc_feature (2503)..(2503): n is a, c, g, or t
ttaggctaggtgcgaggcccggtgtgaatcggccgagggtcacgtccctgtgccagtacttcagcgaggaggacgtggtgtggcggacagaggggctgctgcccctggaggagacctcgccccgccaggccgtctgcctcacccgccacctcaccgccttcggcgccagcctcttcgtgcccccaagccatgtacgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggatggcgacagagccttccaccgcaacagcctggacatcttccggatcgccaccccgcacagcctgggtagcgtgtggaagatccgagtgtggcacgacaaagggctcagccctgcctggttcctgcagcacgtcatcatcagggacctgcagacggcacacagcaccttcttcctggtcaatgactggctttcggtggagacggaggccaacgggggcctggtggagaaggaggtgctggccgcgagtcacgcagccctgttgcgcttccggcgcctgctggtggctgagctgcagtgcggcttctttgacaagcacatctggctctccatatgggaccggccgcctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttctggatgtcccggagcaaggtgggctggggctggggaccggggagtactgggaatggagcctgggcctcggcaccatgcccagagccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatgctcagagccttcacgatagaatttttctaagcagttaaggaagaattaacaccaatccttcacagactctttccaagaatacagcaggtgggaactcttcccattcatacggaaacgggaggccgcaccccttaggaatgcacacgtggggtcctcaagaggttacatgcaaactaaccccagcagcacacagagaaggcgcataagccgcgaccaggaggggttgctcccgagtccgtggcaggaaccagaggccacatgtggctgctcgtatttaagttaattaaaatggaacgttggccgggcgtggtggctcacacctgtaatcccagcactttgggaggcggaggcgggcagatcacttgatgtcaggagttccaagaccagcctggccaacacagtgaaaccccgtctctactaaaaatacaaaaaatcagctgggcatcgtggcaggcacctgtaatcccagctactcaggaggctgagccaggacaatcgcctgaacgcgggaggtggaggttgcagtgagctgagattgcgccagtgcactccagcctgggtgacagagcgagactccatctaagaaaaaaaaaaatgaaattgaaaactctgttccttagctgcaccagtctgctgtcaagtgttcagtggcacacgtcgcgaggggctgccatcacggacggtgcagatgtcccatatatccagcattctaggacattctgtcagatggcaccgggctctgtcctgtctgctgaggaggtggcttctcatccaggtcctgagcaggtctgagctgccgcccgctgaccactgccgtcgtcctgcaggtggctgggagcccgagccccacacctgccgggcagcaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacacttacctttgggttatcaatactctggctgaccatcgtcatcgtgggactgactttgtggagcctngtacttatcattactgtgtttctgagaagttataaatttgccatctccctctgcataactaaccttcgtgtgtctttcctgaagactatcttcccgtctaggagcgtaat

SEQ ID NO: 414024 - DNA, 953 bp, Homo sapiens
gctgttaagtgaaagctttcaccaaacagacttgcagttacagtgtgggtgaaataaagatgaatgatctcatagaagagggtaatacagagtaatttttaataaaaaaaaataagcagaggatacaaaatggttttatgtctaatccaaaagaatgcagattaaaacgaaagtacagtatatgatttgtcaaactggcagataaaacagtgttagaaaaggtattatgatacagccagtctaccactatgtattgcttggtaaatattttatatccttcaaataattttatttaaaaagttaaaaattatctaaagaaatatttagaaatgtgcactgtcaaaagaatacgtaaattttagtgttataatacttaaaagtcagaagcaacctaaatgacccagtcggtgataaagtagctaagtgatagtgcatcttagtggataaaatgttttacccattagtcatgttttaacacctctttgaagggacacacaggaaaatgttttttatatagtacaactctaattttttcctatacatttcacatttgaatgccaaactattgatgttatccatagctgttcagttaaaggagactaaaaacatacttttctgtaatttccaaatagtctacaatgtttgcttttattattgtatcattgtctgagtctacactttgctgtcttttgctctagaaagccatcaggcttggccagaattccctgtggtagcttgctcaggacctgcctaacccacgtgtttcccagcagcctcccttcttttttcctttaaattttaattatgtgtgtgtataagtgcacacactgttttccttcctttgttttctgcttagagtttagagtttagtccatctcagatactgtctttacgcgcaactttcttcacttctttcttccccctttttctcttctcttgggtggttacctcaa

SEQ ID NO: 414025 - DNA, 233 bp, Homo sapiens
gatactatgggttcagtgacatagagacacaattgaattagcaatgagcttcactcaggagccagagaatgggtttgtgtctaagagatgttttaagtaacatttaaatggcactgctgattgataccagcatcaggaagctgaggacaagagctctctgagaaggaagttgccatattacagaagtgaggtgaccaagcacttgttgtaggtctgtacatttagacattaat

SEQ ID NO: 414026 - DNA, 368 bp, Homo sapiens
caaaaaataatcacttttaaggaaaagtcactgttgatagcactcagaatgccaccagtattgcagatttgtaatctattactttaaacttttacaaatgctcatggtgtaaagttcagacccaagttactgaatgtctgttgcctgaaaaggatacttcaaaattatattttccctttaatttcctgaatcaaaaggctccaggttgtgacagaaatgtcactacttgctgtctccattcctgtacagagacccacaagagactgaaaaatggtgttggtcaagttgtcttgggttctgtgccttctgggaccggtaggaatgcagtgtggactgcagtggagctggggttggggagcaaatgcctg

SEQ ID NO: 414027 - DNA, 2633 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414028 - DNA, 1640 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaa

SEQ ID NO: 414029 - DNA, 745 bp, Homo sapiens
atctttcattttatagaaaaatgtaattatgcaatggttatcaggaaagttaattcagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaa

SEQ ID NO: 414030 - DNA, 952 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggtgagaaacatggatacctcctgaaagaagaaaattaatagcactcataatgcctagttaagacaatatcactattatgaacaatcaaaagtaactaaatagatgtaccatccatacaatgaaatattttatagtcactaaaaatgatactgtttgagaaatatttactgatatggggaatgttcaagatatgttaattgaaaaaagcatatgaaataatatgtgcagaattattccaattaagtgaaaaaaaactagagtttctaggttaaactaaagtccgtgtggaagtacaaatgtttgagatt

SEQ ID NO: 414031 - DNA, 1343 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaaga

SEQ ID NO: 414032 - DNA, 1962 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagaaaaaaaaaaaaaaaaaaaaaaaaaaaaaaaaaaaaaaaaaaaaaaaaaaaaaaaagagatgcgagtcgctccgatgcgggggcgctagtgaggagggggacaacgaagagagagttgctgccagcccggggcgacgaacatcagaagggggacggcgcgggaccatccacaagcggaccgggggtggggggggagacccccccgaaagaaaggcgccccccaagagttggggcgtaagaatgacctcaccacagggggggaaaaggaagggagcacccaacattgaccaggcacatgcccacaaggggggggagcgacaccaactgcgtgtggtcgacgaatgcaaggagggggtgtccccccaacaaacaaaaatgtacgacggaagcgacggaatacccgcccccaggaagagataagaaacacttgcgtggacgagaagcccccaacaaagaagaagcgcgctacgaggcaagaacatgaataaagaaccagcccagcaagaggggggggccgcgggcgaaaaagggccaatttatgccgccaaacaagccagccagaaaaagagggggcgggcgtggtttacacacaaaacacgacgcgaacaaacacggtcggt

SEQ ID NO: 414033 - DNA, 2953 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414034 - DNA, 1577 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcaggtaagactgtcagagaaagaaattgctgtcatctaattttcctgttagttctacctatcaaggtaactgagcaggcacaggaaaaaaaggaggagctagataacaaggctcctttattgcttggtcccctgtagtgcttaaagaaggttccagtctcaggatatattttttggagtcttgggttttatttttaatacttataatttttattatagcagattacaaattagacgcagccaaaggaaggaacatatagggtgtagtattggacagttctaaatgttaagcttctgtcatcctcacagatgtgttacccttcagaatctaagtttagcaggcaactctgcagctgactaatagaaaaagcatgtggatataaaagaaatatataaacacaagcagaaaatgatagaaggataaactgtggtactccacagtggaaaa

SEQ ID NO: 414035 - DNA, 3379 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggtaatctgtgtttgagggtgtcctgttttcttttgtggcctgatcaaattttgattttgtttttttaggtgctggcctcgagcccaggtttttggtagacagcatcataaatttcaggccacgtctgccttattctcactggaattctcagtacatttcagtcacattgtagactttgggaaaataagtgaatactggaacccacaagtttccaacctgttggcacccctgttaacagggtgtcctgaagacatctaactttattcagagaaatgtttctagggctaggtttttgttgtcgtcgttgtttttcacccccagttttttaacttccctcccagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414036 - DNA, 3599 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacacactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttgctcataagaattattttctgaatacagtggcttactagtttcttttgaagatttttttccttatcaattctgtattagaaatccatagattgtccaaattttggtaatctagggtttcagatttttttaatcataatatagacttggtttaatgctaattgcatgtgatctttcctgtacctagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414037 - DNA, 2529 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414038 - DNA, 2849 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414039 - DNA, 2718 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414040 - DNA, 2406 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414041 - DNA, 2599 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgactttttttttaacttcctgctgcttcatatcctatagtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414042 - DNA, 2656 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggttatttttatttggttttctaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414043 - DNA, 2409 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414044 - DNA, 2614 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414045 - DNA, 3055 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggaaataacagtacaacagctaatggctcatttggatgctatcaggaaagacatggtcatcctagagaaaagtgaatttgcaaatctgagagcagagaatgaggtgatacaaattttaatttattacttataaaataactgatctcataataagcatcctacttaaggaataagttaataagaccaagtaataattccatgtggttagtaaacaataagtttttagatttaaaaacacactatttgtttaaccatacctaatctttttctatataaatcatagtgctttgcatactgaagagaataagagttacattttatacatataaaaccacataaaacaaaatctttgagctatatatataaaatttgtatataatggtttcagagctgagagtaatacggcattttctattttatttaatcctgtactaaatgtctttgtgacttaaaagtatatttctgtaattaagtcagaattttaagttatgttatccactatagcttatttttaaatttagaaaatcagtttttaaaagtataatataaaaacaaatgcattttgctcataagaattattttctgaatacagtggcttactagtttcttttgaagatttttttccttatcaattctgtattagaaatccatagattgtccaaattttggtaatctagggtttcagatttttttaatcataatatagacttggtttaatgctaattgcatgtgatctttcctgtacctagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414046 - DNA, 1791 bp, Homo sapiens
actcaccccttaaaggcttccgcggctcgataaggttggtgggggaaattggggaaccggaaatcccatttttcaccgcaagagaaccaggcttatcacccatttatttacggccatagcttctaaatacggaactccactataagggaaaaagctggtaacgcctcgccagggtcccgggtccggaatttccccggggtcgactacttcctaattaattccgcggcccgcgttcgactaaaaaacaattgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagagatactgtgtctttattgtgtgtgtgtgagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattattacaacaaaaaagtgtgggttttcaaagtgacttaccatatagttggagattgatttctttttggtaatgaactaaaacaataaattttaaaatgataggccaggcgcggtggctcacacctgtaatctcagcactttgggaggctgaggcgggtggatcacttgaggtcaggagttctagaccagcctggccaacatggtgaaaccccgtctctgctaaaaatacaaaaattagccaggcatggtggcacatgcctgtaattccagctactcgggaggctgaggcaggagaatcttgcagtgagccgagatagcaccactgcactccagcctgggtgacagagcaagactccattacctaaataaataaatgtgtgctttagtgcaaattacaacacttaatatgaaatctgtagagttgctaaatattgagctctgattattacatgtattttttaaatatttgatactcaaaaaccagtttatccctgcttcttaatgtagtttaagttaacccatcttaaatttattacataaaacaaagcttttcttaatgacttcaattcagcaaacattgatatctagtacctactctcaagaaactcataggaaaatttaaattcgtattttgttttgttattagatatattttttcttacaaagtaatatctattagtaaatcatatgtaatttcaaagaaattttaaaatatccttttcatcttagttcttcagtcttacccagatcaagaagacaagaccagaaagtaaacattttgagttcataatgccttggtaatagctataaaagtttgacaatcattattcaaaatagccttgtcatttgtttagctataaacagggaatctgcagtatagagcagtcaagagattggtccatatggtccagtgagtgagagtcaggctttccaactatattttcctcaaaaatctaactgctggtttgttttcaaaagaaaaaccttgacattatcctgtt

SEQ ID NO: 414047 - DNA, 1392 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggtaaagtaatatgtaaaaatgtctcttttgtacagttcttgtgccttgtataactgcttttatgtgtaccagtttataagtttagacttttaaaaactacccttgtagagtctctggcttcctcatagctattatagttaaccagcacttttggggaacctggcaccaggtagatggtcgcccatgagccatgaccttgaagtaagaatcaagatttccacatagtgtgcttttttaaactaaattacttctataatagaaaataactattttttgggccaggcacagtagctcacacctgttaatcctgcactttgggaggctgaggcaggagttcaagaccagtctgggcaacatagcaagaccctgtctca

SEQ ID NO: 414048 - DNA, 1239 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaaga

SEQ ID NO: 414049 - DNA, 1858 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcaagaaaagcaacttatggaaacaactacagaatttacaaaaaaggatactcaaaccaaaagtattatttcagagaccagtaataaaattgacgctgaaattgcttccttaaaaacactgatggaatctaacaaacttgagacaattcgttatcttgcagcttcggtgtttacttgcctggcaatagcattgggattttatagattctggaagtagtattaatgctcatcctgctgtggctgttggcttcttagaacaccaaaccgggagagatttactttgaacattgtcagttgcagcaaaaatttactacacaagattattcgaagtgtatacggactaaaagaggaagtgttttagaatgagaagaaaaaaaaaaaaaaaaaaaaaaaaaaaaaaaaaaaaaaaaaaaaaaaaaaaaaaaagagatgcgagtcgctccgatgcgggggcgctagtgaggagggggacaacgaagagagagttgctgccagcccggggcgacgaacatcagaagggggacggcgcgggaccatccacaagcggaccgggggtggggggggagacccccccgaaagaaaggcgccccccaagagttggggcgtaagaatgacctcaccacagggggggaaaaggaagggagcacccaacattgaccaggcacatgcccacaaggggggggagcgacaccaactgcgtgtggtcgacgaatgcaaggagggggtgtccccccaacaaacaaaaatgtacgacggaagcgacggaatacccgcccccaggaagagataagaaacacttgcgtggacgagaagcccccaacaaagaagaagcgcgctacgaggcaagaacatgaataaagaaccagcccagcaagaggggggggccgcgggcgaaaaagggccaatttatgccgccaaacaagccagccagaaaaagagggggcgggcgtggtttacacacaaaacacgacgcgaacaaacacggtcggt

SEQ ID NO: 414050 - DNA, 1136 bp, Homo sapiens
  misc_feature (1000)..(1000): n is a, c, g, or t
  misc_feature (1078)..(1078): n is a, c, g, or t
  misc_feature (1082)..(1082): n is a, c, g, or t
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcagaaagcacttatggaaacactacgnatttccaaaaggatactcaaccaaagtattattcgagacccgtataaatgacgctgaatgtccttaaactgtgggtcnccantgggacatcgttctgcgtcggttcggcggcaccgggttaacggggattaggccg

SEQ ID NO: 414051 - DNA, 1698 bp, Homo sapiens
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagaggtgaggcaaggcgtcgtgtcatagatgcctgagtgctctctagggagacgatgcccgtggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggtaatctgtgtttgagggtgtcctgttttcttttgtggcctgatcaaattttgattttgtttttttaggtgctggcctcgagcccaggtttttggtagacagcatcataaatttcaggccacgtctgccttattctcactggaattctcagtacatttcagtcacattgtagactttgggaaaataagtgaatactggaacccacaagtttccaacctgttggcacccctgttaacagggtgtcctgaagacatctaactttattcagagaaatgtttctagggctaggtttttgttgtcgtcgttgtttttcacccccagttttttaacttccctcccagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggtgagaaacatggatacctcctgaaagaagaaaattaatagcactcataatgcctagttaagacaatatcactattatgaacaatcaaaagtaactaaatagatgtaccatccatacaatgaaatattttatagtcactaaaaatgatactgtttgagaaatatttactgatatggggaatgttcaagatatgttaattgaaaaaagcatatgaaataatatgtgcagaattattccaattaagtgaaaaaaaactagagtttctaggttaaactaaagtccgtgtggaagtacaaatgtttgagatt

SEQ ID NO: 414052 - DNA, 1155 bp, Homo sapiens
  misc_feature (1085)..(1085): n is a, c, g, or t
  misc_feature (1101)..(1101): n is a, c, g, or t
aacttcaggttccaggctgctgtgcggctaaatgcgactccatctcccccgacccaagcgcgtaatggccgctggctatcttgggggagccagctgttggactatgccccactgccaggaaacaggcgccggaaggttctctgacaagatctcgctttcctagggcggtgaaggcgttcaaaggtcgggaaggggcgctgggagaagcggggcagcgctgagccatgctcgcgaactgtgggtctgtctgtgaagagacccagtttcgtgggaccacggtggcgcctgcgctgggaggtgagcttgtgacagagcgaaaactacaattcccagcattcctgtggtgccagaactaccttgcccgaaagcctgtgcgagatttaccccgtcttccgcctccctcccaccggaaaactctgaggacatgaatagtcgccaggcttggcggctcttgctctcccaaggcagaggagatcgttgggtttcaaggccccgcgggcatttctcgccggccctgcggagagtttttaaaccgttttaaggttgtccacaaaataggcgaataggcacctcttatctctgttcaccttcttgaatcttcagtgccagagttcttcactaccacaaccaaggagggatatgataggcggccagtggatataactcctttagaacaaaggaaattaacttttgatacccatgcattggttcaggacttggaaactcatggatttgacaaaacacaagcagaaacaattgtatcagcgttaactgctttatcaaatgtcagcctggatactatctataaagagatggtcactcaagctcaacaggaaataacagtacaacagctaatggctcatttggatgctatcaggaaagacatggtcatcctagagaaaagtgaatttgcaaatctgagagcagagaatgagaaaatgaaaattgaattagaccaagttaagcaacaactaatgcatgaaaccagtcgaatcagagcagataataaactggatatcaacttagaaaggagcagagtaacagatatgtttacagatcagaaagcacttatggaaacactacgnatttccaaacgttccnaaccaagttttttcgagaccggataatgggcggaatggtctaaaccggtggttc

SEQ ID NO: 414053 - DNA, 818 bp, Homo sapiens
tggggtcgcgcctgctcgagcgaacgggaagagaaggtgccacgccctcctcccggattcacgccttgtgctgggcgacgccgctgcctgctgccccgacttgcccagctcgccccaaggggcgaggactgaggaaagcactgcctttctgttcttaaagcgaacctttgaaggcctgggcttcgcgcccggcttctttctcagccgttgtttccgttttttggtgacaagaggctagtaatctcgtcaggagccaacgtaaggtaatctgtgtttgagggtgtcctgttttcttttgtggcctgatcaaattttgattttgtttttttaggtgctggcctcgagcccaggtttttggtagacagcatcataaatttcaggccacgtctgccttattctcactggaattctcagtacatttcagtcacattgtagactttgggaaaataagtgaatactggaacccacaagtttccaacctgttggcacccctgttaacagggtgtcctgaagacatctaactttattcagagaaatgtttctagggctaggtttttgttgtcgtcgttgtttttcacccccagttttttaacttccctcccagtttttaaaccgttttaaggttgtccacaaaataggcgaataggcacctcttatctctgttcaccttcttgaatcttcagtgccaggtacgctgagccattcggtacccaaacacttctacgctgttatttatactccatattgttacttgtgctattttgctcattgtttcattttaatccacaccagtaacagctgcagtcaaaactgcagtt

SEQ ID NO: 414054 - DNA, 1433 bp, Homo sapiens
agaagcgaccggatcttcaaaccgtgggagtggtgcggcggctagagtccctggactcctcaacctagggagctactcgcgagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414055 - DNA, 1663 bp, Homo sapiens
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414056 - DNA, 777 bp, Homo sapiens
cggacgcgtgggtcgacccacgcgtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414057 - DNA, 393 bp, Homo sapiens
aacaaacactcccgggctctgtggagtgtttgttcatcatcctcttcctccttttcttcttgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414058 - DNA, 405 bp, Homo sapiens
aaaaaaaaaagtagaaaataatagagaaagataaatgaaagaaaagatagaaaagaagataaataagaggaaaataaaatgaaataaagaaagtggtaattagtaaaaaaggaaataaataagatcatcaaaaacagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414059 - DNA, 1869 bp, Homo sapiens
agaagcgaccggatcttcaaaccgtgggagtggtgcggcggctagagtccctggactcctcaacctagggagctactcgcgaggtaaggggcgcgccagactggctcctaaaacgcactcgctcgtccgcactcctcgcgctccgaattcagcctcgcctcacccgggcttcagagcccacagaacttctcagccccgtgtcggcgacgaggagctcatggtaaaacagcgcctagggttttgcttgtttgtttgcttttaacagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414060 - DNA, 1397 bp, Homo sapiens
cggacgcgtgggtcgacccacgcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414061 - DNA, 1782 bp, Homo sapiens
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccaggtcatcagaatgaaggaaagtctgagaaagagttacatcctagaggagactaaagaaacagacaacaaaatgtactgtggtgacctggataggatcctggaacggaaaagggacattagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatga

SEQ ID NO: 414062 - DNA, 1491 bp, Homo sapiens
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414063 - DNA, 350 bp, Homo sapiens
gcggccgcctactatttctactgctcgaattcaagcttctaacgatgtacggggacagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414064 - DNA, 672 bp, Homo sapiens
atctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaatacacacaagtccattgtgatagaaataagtggttgaataagtaaataaatgagggagaagagataaatctcccctacagaaaaatttcaattaattttatgtagatactcctgcttcaaggaggtgtagcatgactgtgtaccccgaaagtgtgggctgtgcttagtgacttgcttccagagactgcaatgtggaaggagacaggagaagtaactttagttggaaacctacaaataccactttggtcaggtcatcgaggttattatcagtgtgaagtcaggttgatagcatatatagtattgtcctccaaaacccataaccctagtctaattctgtaaaaaataggcaacccaaactgagggacattctacaaaatacctgacaagtactcttcaaaactgtccaggtcatcagaatgaaggaaagtctgagaaagagt

SEQ ID NO: 414065 - DNA, 1687 bp, Homo sapiens
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414066 - DNA, 1457 bp, Homo sapiens
agaagcgaccggatcttcaaaccgtgggagtggtgcggcggctagagtccctggactcctcaacctagggagctactcgcgagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414067 - DNA, 1763 bp, Homo sapiens
  misc_feature (1667)..(1667): n is a, c, g, or t
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgatacngtcgaaaaaaaaaaggggggcaaattcccaggggcgatagcgacacttttaaaggccgcaagggatacagggcgggtaacgccggaaccgcttgaa

SEQ ID NO: 414068 - DNA, 1529 bp, Homo sapiens
agaagcgaccggatcttcaaaccgtgggagtggtgcggcggctagagtccctggactcctcaacctagggagctactcgcgagatgcctacgacttgtaacgggctgcctggtaaaatgagtctatggaaacggttgccagggccggctaacagcggctcccggaagtcctttgatgctttgttaacagtgaagctactggaccaatgaggtgcttcttccggttttgtccgcgctcgcctaattcttctttatcaaggttgcctttgaccccggaaaagagatcttccgggttcctctctccccaagatggcatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactcccctgccaaggaaaaccatgggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattctctgaaaaaataataaaagtcccctctattatatgagcctgtacagaaaaaaaaaaaaca

SEQ ID NO: 414069 - DNA, 1112 bp, Homo sapiens
cccagatttctggttagttttgtcccttgatcaatgtttattactttatttttggtagatttgcttgcatgagttcttccatatacccctttccatcgcccatcactctacctccagcctgggcaagacagagcgagactctgtctcaaaagaaaaaaagggaaaagaaaagaaagatgcccaattaaaaggctgttgtattagtccaggccaggaagataacaagccgggactaaagcctggactaactgggcagtgagagggaagatggttcaaaggtaaaactgacatgatctgtgaccgacctcaggtggaagatgagggagaaaatgcattcaggataactggcaggttctctttgcactgctggtcaggtctgggcatcagtttcaggatggcagtccacaaaagaacaggctttgggttgacacacccctcctctgttttcctcacatttttatcatgaaaaatttcaaccttcagaaaagtggaaagaatcctacaacgaacactattaaagtctgcacctagatctgacgttcttgcattttgccgcacttgctttatgtatctatatttgtatgtgtattttaactacaccatccaaaacttacagatgtaatatacttttcccccagtgtgtttcagggacctgtcctaggccaccttgctcttcccttaagcccatagccagtgacggacaagcatggggctgagccctcctacctcaaggagggagtgtcgtgtggttcacacttgtgagctccctgtgggatcaagctgaagctgagaaggagacaagcaggaggatcacctgtggctgggagtttaagaccagcctgggcaatatagtgagatcccatctctacaaaaatacttaaaaaaattaggcgtgcacctgctactcaggaagctgtggcgggaggatcacttgggcccaggagtttgaggctgcagtgagccacgatcatgccactgcacaacaacctgggcaacagagcgagaccctgaccctaaaaaagaaagaaagggccaggcacagtggctcttgcctgtaatcccagcactttgggaggcccaggtgggcagatcacgaggtcaggagttcgaga

SEQ ID NO: 414070 - DNA, 315 bp, Homo sapiens
ggagactttaatcctaacaggcaaattacttaggaattatttatttccattttagttgatagaaaaaaacaatacctttatttctggtcactgttcatcctttctctcataaaagaagaggaggggcctgggcaatagaggctatcaaagctttattggccaattatcccccaatcaaaaaagaatgagacaaaaggaaacaaggacagcatagctattatattcagcagataattcttcatgttgacatgctattaatagtatcataagaggtgacaagatccatcggctaaaagaaccactggctaaatatta

SEQ ID NO: 414071 - DNA, 2083 bp, Homo sapiens
gaattctccctaattcattctatgaggccaaccagcatcacactgataccaaaaccagagatagacacaacaaaaaaaagacaactacagggtatgcagaggtgccccaaccacactctgtccacagactctcagttattttaggagatccctggccaagatttatttctgttgacaaccaaggcctccgtctggatttccaaggaagaaatttcctttgaagcactggaacttgccaccaccagcaccatgccctaccgatatccagcattgaccctggagcagaagaaggagctgtctgacatcgctcaccgcatcgtggcactgggcaagggcatcctggctgcagatgagtccactgggagcattgccaagcggctgcagtcccttaacgccgagaacaccaaagagaactggcgcttctactgtcagctgctgctgacagctgacgactgcgtgaacccctgcatcggggacgtcatcctcttccaccagacactctaccagaagaaggatgatgggcgtcctttcccccaagttgtcatgtccaagggtggtgttgggggcagcaaggtagacaagggcgtggtctcttgcagggacaaatggcgagaccaccacccaagggttgtatgggctgtctgagtgctgtgcccagtacaagaaggatggagctgacttcaccaagtggcattgtgttctgaagattggggaacacaccccctcagcccttgccgtcatggaaaataccaacgtcctggcctgtcatgccagcatctgctagcagagtggcattgtgcccattgcggagcctgagatcccccctaatggggaccatgacttgaagcactgccagtgtgtgaccaagaaggtgctgactgctgtctacaaggctctgagtgatcaacacatctatcttggagggcatcttgctgaaccccagcatggtcaccccaggccatccctgcatccagaagttttctcacgaggagattgccatggtgactgtcacaacgctgcaccgcacagtgccccccgctgtccctgggatcacattcctgtctggaggccagaatgaggaggaggcatccatcaacctcaacgccattaacaagtgctccctgtgaccttctcctatggccgagccctgcaggcctctgccctgaaggcctggggcaggaagaaggagaacctgaaggctgcccaggaggagtcaagtgagccgtggccaacagcctggcctgtcaaggaaagtacaccccaagcagtgagactggggctgctgctagagagtccctcttcatctctaaccatacctactaagtggaggtgttccccggctgttcccaacactccaggccccgcccctactctcttgaagagcgggccttctcctcaggtctccaggttggcttgcccgtgctcttgcctccctcgtgacagtggtgtgtggtgtcgtctgtgaatgctaactccatcaccctttccagcacactgccaataaacagctattcaaggttggaggagggggggcggggagagaactacagccagtatccccaatgaacatagatacaaaatttctcaacaaaataccagcaaactaaatgcaacagcacatcaaaaagacaatataccgtgatcaagtgggatttatagcagggacgcaaggatgcttcgacacacacaaatccgtaaacatgacacatcacaccaacaaaatgaaggacaaaaaccatatgattatctcaataggcacagaaaaagcatttgataaaattcaacatcgctttatgataaacactctcaacaaactagacatagaaggaacataactcaaaataacaaagaccatatacagccaacccacagctaacatcatactgaatggagtaaagttgaacgcctttgctccaagaactgaaacaagacaaggattctcactttcaccattcctattcaacatagtactagaagtcctagccagagcaatcagtcaagagaaagaaataaaaagcatccaaattggaaaagaagaagtgaaactgtctctttttgctgaggacatgatattatatctaga

SEQ ID NO: 414072 - DNA, 109 bp, Homo sapiens
catgggctccatggaaaggtatgacagcatctgcaatgtctgggagagtatggccagcatgcccgtgggggtgctccaccccgcagtcgctgtgaaagaccaaagactc

SEQ ID NO: 414073 - DNA, 1843 bp, Homo sapiens
  misc_feature (1806)..(1806): n is a, c, g, or t
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgccgatgcagaaccgcttnttctcttctcctaccctcatacaacacctatacacac

SEQ ID NO: 414074 - DNA, 1845 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttggatcggcagtcaataaagtaccgaacacgcataaactgtaacaactactaaccacgt

SEQ ID NO: 414075 - DNA, 4263 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414076 - DNA, 4541 bp, Homo sapiens
agcagttctcgagcctcagcctcccgagtagctggaattacaggctgcgcgcctgatggccggctaatttttttgtatttgtttttctttttagtagagacggggtttctccgtgttggccaggctggtctcgactcctggtctcaagcagtctgcccacctcggcctccccctcccaaagtgctgggattacaggcctgagccaccgtgcccggcccaacaaatattgattttagatcagtctttctgggacttctcagcaatgactcttttgacaacggatatgtttacagaactttttaaacatttttgctgaaaaaaaagtggatttagctctgtgttagttttggatcgctatatacaatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414077 - DNA, 4350 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcagaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414078 - DNA, 4304 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaatgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414079 - DNA, 1628 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtacccccccccactagagtactccctctcacttgcggtttccttatactccacccctttctcaacggtccttttttaaagcacatctcagatta

SEQ ID NO: 414080 - DNA, 3844 bp, Homo sapiens
  misc_feature (1)..(1): n is a, c, g, or t
  misc_feature (3)..(3): n is a, c, g, or t
ncntgctggaacgactctcttaatcctccaccgctacaagtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414081 - DNA, 4346 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgctggagttgcaatggcacgatctcggctcaccacaacctacacctcctgggttcaagcgattcttctgcctcagcctcctgagtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414082 - DNA, 1535 bp, Homo sapiens
  misc_feature (1516)..(1516): n is a, c, g, or t
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaaaaaaaaaaacaaaaacataaaaaaaaatttttgggcgcgcctgccctcgaaaattttctcacacccctcgtgtggcgccggccccaggtatggaacatgccaagcgtctcccacaggacaccggcccgcaacgggtgggttcccccaanaaaccggggccgaggttca

SEQ ID NO: 414083 - DNA, 1600 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccaagcaacccctaggggttgcttggttgggaggggtgctccctctcttcgctacaatcaaatatccacagaagttcgaggccagaatcacgataaccacggacgagtcaacgcgcacaaattacatggagttgaggggtctcacatctgaagacacggccgtatatttttgtgcgagagtggacctgagtccccactacgaaggctactatttcgacccctggggccaggtaaccct

SEQ ID NO: 414084 - DNA, 3631 bp, Homo sapiens
ggttgtttaaaagtgtgtagcacctacacctttgctctcttcctccttctccggctgtgcctgcttcctgtttacctttgccatgattggaagtttcctgaggcctccccagccgtgcctcacagcctgcagaactgtgagccagttagacctcttttctttataaattacccagtctcaggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414085 - DNA, 1484 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttggatcggcagtcaataaagtaccgaacacgcataaactgtaacaactactaaccacgt

SEQ ID NO: 414086 - DNA, 3348 bp, Homo sapiens
  misc_feature (1)..(1): n is a, c, g, or t
  misc_feature (3)..(3): n is a, c, g, or t
ncntgctggaacgactctcttaatcctccaccgctacaatgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414087 - DNA, 3284 bp, Homo sapiens
  misc_feature (1)..(1): n is a, c, g, or t
  misc_feature (3)..(3): n is a, c, g, or t
ncntgctggaacgactctcttaatcctccaccgctacaacgcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414088 - DNA, 3482 bp, Homo sapiens
gatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414089 - DNA, 3143 bp, Homo sapiens
caagcattcatcttcaataaactatattactaaaagaaagacagaaaattttcagctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414090 - DNA, 916 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgctggagttgcaatggcacgatctcggctcaccacaacctacacctcctgggttcaagcgattcttctgcctcagcctcctgagtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagaggtaagttgtaaatatca

SEQ ID NO: 414091 - DNA, 255 bp, Homo sapiens
aaggctcctcaggctgcaggaaagattcacacagattttgaaaagggattcattatggctgaagtaatgaaatacgaagattttaaagaggaaggttctgaaaatgcagtcaagaggtaaagaattgtttttatttttgtatttcacaatgtttccactgatgcgaagttagtcatgataaaaatgaatgataattatcttttaaactgagtgtagtctaaaataaagtaataagatgatcagcgtttagtgtta

SEQ ID NO: 414092 - DNA, 335 bp, Homo sapiens
aggttgttgaaaagatggtgaattgagggatgaaaacagtgggtttttttatttgggagaaacaaaaattattttctgtctaattatgaccacagtaatacatttatattgtaggtgaagtggcccattgctgtcatatgtgtgcaccttcctcaacacccatttatacctcacagaaattgaaagagattttttaatttcatttttatttttatttttatttttttgagacggagttttgctcttgttgcccaggctggagttgcaatggcacgatctcggctcaccacaacctacacctcctgggttcaagcgattcttctgcctcagcctcc

SEQ ID NO: 414093 - DNA, 4364 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414094 - DNA, 2003 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgaaaaaaacacaaaaaaggcggaggccgaacataaagaagaatcccctgagagggggccccaaaggaagtaaggggtaccccaggtatgtctgtgcgacaaaagggggccccaataagggcgcccgatataataacggataggcagtggccggcggatacacaaacggccgtgcacgggaaaacgggcaccgcggcgaaccttcgggaaggaacct

SEQ ID NO: 414095 - DNA, 1841 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttggggatgcgtcaggacttctttcttattaatgatacgatttgagatgtgtggat

SEQ ID NO: 414096 - DNA, 4339 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414097 - DNA, 4303 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatgagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414098 - DNA, 4327 bp, Homo sapiens
ggtctgcgcgcaggtgccgctcggcgcccggcccgcccgttccgccgctgtcgccgccgtcgtgcgtgccgctcggcggaggggacgggcctgcgttctctcctccttcctccccgcctccagctgccggcaggacctttctctcgctgccgctgggaccccgtgtcatcgcccaggccgagcacgatgccccctaaaaagggaggtgatggaattaaaccacccccaatcattggaagatttggaacctcactgaaaattggtattgttggattgccaaatgttgggaaatctactttcttcaatgtgttaaccaatagtcaggcttcagcagaaaacttcccgttctgcactattgatcctaatgagagcagagtacctgtgccagatgaaaggtttgactttctttgtcaataccacaaaccagcaagcaaaattcctgcctttctaaatgtggtggatattgctggccttgtgaaaggagctcacaatgggcagggcctggggaatgcttttttatctcatattagtgcctgtgatggcatctttcatctaacacgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaagttgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga

SEQ ID NO: 414099 - DNA, 4021 bp, Homo sapiens
gggaacaggaatgcaggagcaagtatacagggtggaagccagcctggcggctttagtcccgggcagaaccaagtcactccacaggatcatgagaaggctgcttgattatgcaggttctacaactgactgcagaccagatgccatgtgcctcctgagcaaaggcagagtatcctgatttgagtcattcaagggttaggatgcaggtcatctaacagcgtgcttttgaagatgatgatatcacgcacgttgaaggaagtgtagatcctattcgagatatagaaataatacatgaagagcttcagcttaaagatgaggaaatgattgggcccattatagataaactagaaaaggtggctgtgagaggaggagataaaaaactaaaacctgaatatgatataatgtgcaaagtaaaatcctgggttatagatcaaaagaaacctgttcgcttctatcatgattggaatgacaaagagattgaagtgttgaataaacacttatttttgacttcaaaaccaatggtctacttggttaatctttctgaaaaagactacattagaaagaaaaacaaatggttgataaaaattaaagagtgggtggacaagtatgacccaggtgctttggtcattccttttagtggggccttggaactcaagttgcaagaattgagtgctgaggagagacagaagtatctggaagcgaacatgacacaaagtgctttgccaaagatcattaaggctgggtttgcagcactccaactagaatactttttcactgcaggcccagatgaagtgcgtgcatggaccatcaggaaagggactaaggctcctcaggctgcaggaaagattcacacagattttgaaaagggattcattatggctgaagtaatgaaatacgaagattttaaagaggaaggttctgaaaatgcagtcaaggctgctggaaagtacagacaacaaggcagaaattatattgttgaagatggagatattatcttcttcaaatttaacacacctcaacaaccgaagaagaaataaaatttagttattgctcagataaacatacaacttccaaaaggcatctgatttttaaaaaattaaaatttctgaaaaccaatgcgacaaataaagttggggagatgggaatctttgacaaacaaattatttttatttgttttaaaattaaaatactgtgtaccccccccccctccatgaaatgcaggttcactaaatgtgaacagctttgcttttcacgtgattaagaccctactccaaattgtagaagcttttcaggaaccatattactctcatgatacttcattaatctccatcatgtatgccaagcctgacacatttgacagtgaggacaatgtggcttgctcctttttgaatctacagataatgcatgttttacagtactccagatgtctacactcaataaaacatttgacaaaaccagacttggtgtgtttggggatgtctgtattgactgactgtggtgtgctgaatgcgatacggcacctggtggttgctgattacagaattttaaggcgtgtgtatgacacagtaactggcagtgtggggcagctgcaattgtatcttaaaagtgagtctttcatgggaatcagaagaatagtataccagggatttgtctcaaaaaagttaattaatttatagatcaacatttattgaaagatgatagcaatgatattatgagggatatgagataggtgactgaccacaaagaagaaaattctgtctcaaaaattaaagaattttgtttgttattgttgttctgaccatattgaaaagaggttcacttttaatctttcctttgaaattattaaattgtaaaaactgacccattgatgtctggtgggttatgttttgcttcaattcagcaatgtgtataaaagttcctacactgattttgaaatactaagatcagactttgaaaattttaaaaattctttcattcttacttttcagatatttgagagcagtcgaagtggtagtatgggtaagttaagcacttcttaacattgtagcagaaaattccaaaagaaagactagaacaaattggtaatttggagaccctttgccacttagccttctcttgtgatgatggcctgaaagctctctcggccctgagcctccctttctctcccatgtttccattcctgtgagacctcccttccttgtccttgtcctctgcccttttgtgctcttctgtgatcacaggaccatttccatggaatgcagattcatacccagccagcctttgcctctactgtatcgctttgggactttaaagatgcagaagtattagaacacacacaaacttaaaatggaaagttaccaaatgtagcactagaggcaagaaaaggggtgattttttaaagatttggctatacttaagatatttaaagaggatgaggttgagtcgtgagtataatttagaagctctccagtgagtatttttttagtatcaaatagtgatcttcttttgctaacataaaaatgagtaaactacagcagagaaataagaataaaactaatgaagggttttttaaaagaactaaataaaacaaataaaactaggctacaggtatagctgaccaagtttgctgtgaaaaatccttgttatatctatttctgtattggagtaatgtgtagattagtggattgttagggatttcagcagtataagaaagaatcaaatatcttgcttttgggtcttctccaaagtaaattgcatggacttcttaaagaagtttgaaatcagtaaaaagacattaggatcatgcaattttactttgtctagcttctaatgtggtaaattgcacattgtgcaacagaaccattaataaaagaaaggagttagttttgaggtaactgcattcattaggggctgaaaataaatgttaaaaatgtttaatttggttagaagttctacaacattgtatgtacatatacaaaatttcattttctctgaaagtcgagaattccaagaactgttacatataatcatatatatgcctatatctaaacgttttccctcctttaatattgataaagttaatatattttaggatgttatgtaaatatttttgcatgtatctgtagctccatcttaatcaaatttatggttaaaagagatttgaggccaggcgtggaggctcacacctataatcccaacactttgggaggccgaggtgggaggatcacttgagcacaggagtttgagaccagcctgtgcaacatcatgaaacatcatctctacataaaaaaatacatatatacaaaaattagctgggcatcatggcacacacctgtagtcccagctacttaggaggctgagatgggaggattgatcgatcgcttgagcctgggaggtggaggctactgtgagccatgatcatgccactgcactccagcctgggcaacagagtgagaccctgtctccaaagagaaagagaaacttgagaaggcttgtgcccaaagcttgaagaaagattgtaatagcatttagttgtgttttatcatgttatcttcataacatgcattttgcatatggctcagagcagagccggatctcccaaggaagcacaaatagtttttgtcgctaacttagttatgagtgaagcctctgttcacttataacttgccagtttcattggtggaataagtccccttactcatgattcatcaatattcctatattagaattccagtttgatgtttgtctctagttgtctgtgtataatatttccaaagctcctttgtaaaccccgtctcctttcattcagagagtcagagacggtatctcctcctcctgcctcttctattgttctgattagtctacttaaattcacttgatgctctttttattttacaagagacttgagaaatgttggttgttcctaatggcaaactactttagctgggaaaattcatttcaacttattttaagcttgtaaaatacactgtggtgataaaataaaagagctgggtttgacttttga
